US007150982B2

(12) United States Patent
Allawi et al.

(10) Patent No.: US 7,150,982 B2
(45) Date of Patent: Dec. 19, 2006

(54) RNA DETECTION ASSAYS

(75) Inventors: Hatim T. Allawi, Madison, WI (US); Brad T. Argue, Sun Prairie, WI (US); Christian Tor Bartholomay, Madison, WI (US); LuAnne Chehak, Janesville, WI (US); Michelle L. Curtis, Cottage Grove, WI (US); Peggy S. Eis, San Diego, CA (US); Jeff G. Hall, Madison, WI (US); Hon S. Ip, Madison, WI (US); Lin Ji, Madison, WI (US); Michael W. Kaiser, Madison, WI (US); Robert W. Kwiatkowski, Verona, WI (US); Andrew A. Lukowiak, Stoughton, WI (US); Victor Lyamichev, Madison, WI (US); Natalie E. Lyamicheva, Madison, WI (US); WuPo Ma, Madison, WI (US); Bruce P. Neri, Carlsbad, CA (US); Sarah M. Olson, Cross Plains, WI (US); Marilyn C. Olson-Munoz, Madison, WI (US); James J. Schaefer, Madison, WI (US); Zbigniev Skrzypczynski, Verona, WI (US); Tsetska Y. Takova, Madison, WI (US); Lisa C. Thompson, Madison, WI (US); Kevin L. Vedvik, Madison, WI (US)

(73) Assignee: Third Wave Technologies, Inc., Madison, WI (US)

( * ) Notice: Subject to any disclaimer, the term of this patent is extended or adjusted under 35 U.S.C. 154(b) by 292 days.

(21) Appl. No.: 10/084,839

(22) Filed: Feb. 26, 2002

(65) Prior Publication Data
US 2003/0186238 A1    Oct. 2, 2003

Related U.S. Application Data

(60) Continuation-in-part of application No. 09/864,636, filed on May 24, 2001, now Pat. No. 7,045,289, and a continuation-in-part of application No. 09/864,426, filed on May 24, 2001, which is a continuation-in-part of application No. 09/758,282, filed on Jan. 11, 2001, now Pat. No. 6,635,463, and a continuation-in-part of application No. 09/577,304, filed on May 24, 2000, now Pat. No. 6,759,226, and a continuation-in-part of application No. 09/381,212, filed on Feb. 8, 2000, and a continuation-in-part of application No. 09/350,309, filed as application No. PCT/US98/05809 on Mar. 24, 1998, now Pat. No. 6,348,314, which is a division of application No. 08/756,386, filed on Nov. 26, 1996, now Pat. No. 5,985,557.

(51) Int. Cl.
*C12N 9/22* (2006.01)

(52) U.S. Cl. .......................................... 435/199; 435/6
(58) Field of Classification Search ................ 435/199, 435/6
See application file for complete search history.

(56) References Cited

U.S. PATENT DOCUMENTS

| 5,244,797 A | 9/1993 | Kotewicz et al. ............ 435/194 |
| 5,268,289 A | 12/1993 | Dahl et al. .................. 435/199 |
| 5,459,055 A | 10/1995 | Jendrisak et al. ............ 435/199 |
| 5,466,591 A | 11/1995 | Abramson et al. .......... 435/194 |
| 5,500,370 A | 3/1996 | Jendrisak et al. ......... 435/320.1 |
| 5,541,311 A | 7/1996 | Dahlberg et al. ........... 536/23.7 |
| 5,614,402 A | 3/1997 | Dahlberg et al. ............ 435/199 |
| 5,795,762 A | 8/1998 | Abramson et al. .......... 435/194 |
| 5,795,763 A | 8/1998 | Dahlberg et al. ............... 435/6 |
| 5,837,458 A | 11/1998 | Minshull et al. ................ 435/6 |
| 5,843,669 A | 12/1998 | Kaiser et al. .................... 435/6 |
| 5,846,717 A | 12/1998 | Brow ............................. 435/6 |
| 5,874,283 A | 2/1999 | Harrington et al. ....... 435/252.3 |
| 5,985,557 A | 11/1999 | Prudent et al. .................. 435/6 |
| 5,994,069 A | 11/1999 | Hall et al. ...................... 435/6 |
| 6,001,567 A | 12/1999 | Brow et al. ..................... 435/6 |
| 6,090,606 A | 7/2000 | Kaiser et al. ................ 435/199 |

FOREIGN PATENT DOCUMENTS

| WO | WO 97/27214 | 2/1997 |
| WO | WO 98/27230 | 6/1998 |
| WO | WO 98/31837 | 7/1998 |
| WO | WO 98/42873 | 10/1998 |
| WO | WO 99/65927 | 12/1999 |
| WO | WO 00/18906 | 4/2000 |

OTHER PUBLICATIONS

Sigma Chem. Co. Catalog (1995), pp. 1453-1457, 2315.*
Kaiser et al., J. Biol. Chem., 274:21387 [1999].
Lyamichev et al., Nat. Biotechnol., 17:292 [1999].
Lyamichev et al., Science 260:778 [1993].
Kwiatkowski et al., Molec. Diagn., 4:353 [1999].
Marmur and Lane, *Proc. Natl. Acad. Sci USA* 46:453 [1960].
Doty et al., *Proc. Natl. Acad. Sci USA* 46:461 [1960].

(Continued)

*Primary Examiner*—Charles L. Patterson, Jr.
(74) *Attorney, Agent, or Firm*—Medlen & Carroll, LLP

(57) ABSTRACT

The present invention provides novel cleavage agents and polymerases for the cleavage and modification of nucleic acid. The cleavage agents and polymerases find use, for example, for the detection and characterization of nucleic acid sequences and variations in nucleic acid sequences. In some embodiments, the 5' nuclease activity of a variety of enzymes is used to cleave a target-dependent cleavage structure, thereby indicating the presence of specific nucleic acid sequences or specific variations thereof.

5 Claims, 192 Drawing Sheets

OTHER PUBLICATIONS

Nielsen et al., Anticancer Drug Des. 8:53 [1993].
Mullis and Faloona, Methods in Enzymology, 155:335 [1987].
Eom et al., Nature 382:278 [1996].
Minnick et al., J. Biol. Chem., 271:24954 [1996].
Polesky et al., J. Biol. Chem., 267:8417 [1992].
Kiefer et al., Nature 391:304 [1998].
Ollis et al., Nature 313:762 [1985].
Kim et al., Nature 376:612 [1995].
Korolev et al., Proc. Natl. Acad. Sci., 92:9264 [1995].
Doublie et al., Nature 391:251 [1998].
Pelletier et al., Science 264:1891 [1994].
Ceska et al., Nature 382:90 [1996].
Del Rio et al., Biotechniques 17:1132 [1994].
M.J.R. Stark, *Gene* 5:255 [1987].
Studier and Moffatt, J. Mol. Biol., 189:113 [1986].
Sambrook et al. *Molecular Cloning*, Cold Spring Harbor Laboratory Press, Cold Spring Harbor, pp. 1.63-1.69 [1989].
Engelke et al., Anal. Biochem., 191:396 [1990].
Myers and Gelfand, Biochemistry 30:7661 [1991].
Johnson et al., Science 269:238 [1995].
Higuchi, in PCR Technology, H. A. Erlich, ed., Stockton Press, New York. pp. 61-70 [1989].
Brautigam et al., Curr. Opin Struc Biol. 8(2):54-63 (1998).
Urs et al., Acta Crystallogr D. Biol. Crystallogr 55(Pt 12):1971-7 (1999).
Xu et al., J Biol. Chem. 275:20949-20955 (2000).
Van Deuren et al., J. Int. Fed. Clin. Chem., 5:216 [1993].
Van Deuren et al., J. Inf. Dis., 169:157 [1994].
Perenboom et al., Eur. J. Clin. Invest., 26:159 [1996].
Guidotti et al., Immunity 4:25 [1996].
Grant et al., Transplantation 62:910 [1996].
Mellors et al., Science 272:1167 [1996].
Saag et al., Nature Medicine 2:625 [1996].
Lyamichev et al., Prot. Natl. Acad. Sci., 96:143 [1999].
Li et al., Protein Sci., 7:1116 [1998].
Joyce and Steitz, Trends in Biochemical Science 12:288 [1987].
Breese et al., Science 260:352 [1993].
Polesky et al., J. Biol. Chem., 265:14579 [1990].
Pandey et al., Eur. J. Biochem., 214:59 [1993].
Holm and Sander, J. Miol. Biol., 233:123 [1996].
Holm and Sander, Science 273:595 [1996].
Li et al., EMBO J., 17:7514 [1998].
May et al., Proc. Natl. Acad. Sci., 83:8957 [1986].
Xu et al., J. Biol. Chem., (2000) 275(27), 20949-20955.
Doherty et al., Nucl. Acid Res., 24:2488 [1996].
Saiki et al., Science 230:1350 [1985].
Hwang et al., Nat. Struct. Biol., 5:707 [1998].
Hall et al., PNAS 97:8272-8277 [2000].

* cited by examiner

MAJORITY [SEQ ID NO: 156] AGAACATCCCCGTCCCCACCCCXCTGGGCCAGAGGATCCGGCCGGGCCTTCGTGGGCCGAGGAGGGXTGGGT

| | | |
|---|---|---|
| DNAPTAO [SEQ ID NO: 153] | ........................G..T..G.............A..C.............G....C.. | 1814 |
| DNAPTFL [SEQ ID NO: 154] | ........................G........T........C..C........A..............C... | 1811 |
| DNAPTTB [SEQ ID NO: 155] | ........................CT..........................................C..T...C | 1820 |

MAJORITY GTTGGTGGCCCTGGACTATAGCCAGATAGAGCTCCGGGTCCTGGCCCACCTCTCCGGGGACCAGAACCTG

| | | |
|---|---|---|
| DNAPTAO | A...................................A.....G.........C............... | 1884 |
| DNAPTFL | .C......T..T......C........T........T.........................A........ | 1881 |
| DNAPTTB | ........................................C.......C..................... | 1890 |

MAJORITY ATCGGGTCTTCCAGGAGGGACACTCCACACCCAGACCCAGCTGGATGTTCGGCGTCCCCCGG

| | | |
|---|---|---|
| DNAPTAO | ................C.................GG......................... | 1954 |
| DNAPTFL | .........T.....................................................TT.....C... | 1951 |
| DNAPTTB | ....A..............A...........A............................. | 1960 |

MAJORITY AGGCCGTGGACCCCCTGATGCGCCGGGCCAAGACCATCAACTTCGGGGTCCTCTACGGCATGTCCGC

| | | |
|---|---|---|
| DNAPTAO | .A.GG..A....T.................................G............G... | 2024 |
| DNAPTFL | ..........................................GG.G.............C... | 2021 |
| DNAPTTB | ................................................................. | 2030 |

MAJORITY CCACCGCCCTCTCCCAGGAGCTTGCCATCCCCTACGAGGAGGCGGTGGCCTTCATTGAGCGCTACTTCCAG

| | | |
|---|---|---|
| DNAPTAO | ..............A......T................CCA................T... | 2094 |
| DNAPTFL | .......GG..........T.......................................T.A.... | 2091 |
| DNAPTTB | ...TA.G............................................................A | 2100 |

```
                                                                                    2499
                                                                                    2496
                                                                                    2505
MAJORITY [SEQ ID NO: 156] CCCCCTGGAGGTGGAGGTGGGGATGGGGAGGTGGGGAGGACTGGCTCTCCGCCAAGGAGTAG

DNAPTAG [SEQ ID NO: 153] ................A...........................................GA
DNAPTFL [SEQ ID NO: 154] ....................CC......................................
DNAPTTM [SEQ ID NO: 155] ...........................................T.........GT....
```

FIG. 9A

```
MAJORITY [SEQ ID NO:159] MXAMLPLFEPKGRVLLVDGHHLAYRTFFALKGLTTSRGEPVQAVYGFAKSLLKALKEDG-DAVXVVFDAK

TAQ PRO  [SEQ ID NO:157] .RG..........................H.................................I......   69
TFL PRO  [SEQ ID NO:158] .............................................................V.V......   68
TTH PRO  [SEQ ID NO:1  ] .E...........................................................YK..F....   70

MAJORITY  APSFRHEAYEAYKAGRAPTPEDFPROLALIKELVDLLGLXRLEVPGYEADDVLATLAKKAEKEGYEVRIL

TAQ PRO   ..................GG...........................A............S.........   139
TFL PRO   ....................................V........F...R.....................   138
TTH PRO   .............................................FT.......................   140

MAJORITY  TADRDLYQLLSDRIAVLHPEGYLITPAWLWEKYGLRPEQWDYRALXGDPSDNLPGVKGIGEKTAXKLLX

TAQ PRO   ...K........................H...................D.A......T.E.........R..E   209
TFL PRO   .............E..I...............Y.....................A....I........QR.IR   208
TTH PRO   ........V..V.......H..E..........................F..V................L..K   210

MAJORITY  EWGSLENLLKNLDRVKP-XXREKIXAHMEDLXLSXXLSXVRTDLPLEVDFAXRREPDREGLRAFLERLEF

TAQ PRO   ........A..........L..AI......L...D..K..WD.AK..................K.........R..   278
TFL PRO   ...........FQH..Q..-SL...LQ.G..A.A..RK..Q.H...........GR..T.NL............   277
TTH PRO   ...........ENV......K.L...R..LE..R................L.QG...................   280

MAJORITY  QSLLHEFQLLEXPKALEEAPWPPEGAFVGFVLSRPEPMWAELLALAAARXGRVHRAXDPLXGLRDLKEV

TAQ PRO   ............S.....................K......D..........G..........PE.YKA.....A   348
TFL PRO   ........G..A.................L..SF................G.WE..L..Q...R......G.   347
TTH PRO   ........A.AP.........................K......C.D..............A...A...K......   350
```

FIG. 9B

```
MAJORITY [SEQ ID NO: 159] RGLLAKDLAVLALREGLDLXPGDDPM LAYLLDPSNTTPEGVARRYGGEWTEDAGERALLSERLFXNLXX

TAQ PRO [SEQ ID NO: 157]    ...........S...........G.P...............E.......A.......A..WG  418
TFL PRO [SEQ ID NO: 158]    ..I............F.E.....................A....QT.KE              417
TTH PRO [SEQ ID NO: 1  ]    ...........S...V.......................AH........HR..LK         420

MAJORITY  RLEGEERLLWLYXEVEKPLSRVLAHMEATGVRLDVAYLQALSLEVAEEIRRLEEEVFRLAGHPFNLNSRD
TAQ PRO   ......R....R....A...................R.................A.................  488
TFL PRO   ..K.....E.........R.....................EA.V.Q...........................  487
TTH PRO   ......K.........H.......................L...............................  490

MAJORITY  QLERVLFDELGLPAIGKTEKTGKRSTSAAVLEALREAHPIVEKILQYRELTKLKNTYIDPLPXLVHPRTG
TAQ PRO   ...................................................S.........D.I........  558
TFL PRO   .............................DR....................A....K..............  557
TTH PRO   ......R...L...Q...................H.................V...S...............  560

MAJORITY  RLHTRFNQTATATGRLSSSDPNLQNIPVRTPLGQRIRRAFVAEEGWXLVALDYSQIELRVLAHLSGDENL
TAQ PRO   ..........................................I.......L.....................  628
TFL PRO   ..................................................V..V.................  627
TTH PRO   ....................................................A.A................  630

MAJORITY  IRVFQEGRDIHTQTASWMFGVPPEAVDPLMRRAAKTINFGVLYGMSAHRLSQELAIPYEEAVAFIERYFQ
TAQ PRO   ..............E.............R.................................Q.........  698
TFL PRO   ..K...........................S..G...................G.S...............  697
TTH PRO   ..............................................V........................  700
```

FIG. 9C

```
MAJORITY [SEQ ID NO: 159] SFPKVRAWIEKTLEEGRRRGVVETLFGRRRYVPDLNARVKSVREAAERMAFNMPVQGTAADLMKLAMVKL

TAQ PRO [SEQ ID NO: 157] .........................E.................................... 768
TFL PRO [SEQ ID NO: 158] .Y......G............................R.......................... 767
TTH PRO [SEQ ID NO: 1  ] ................K................................................ 770

MAJORITY  FPRLXEMGARMLQVHDELVLEAPKXRAEXVAALAKEVMEGVYPLAVPLEVEVGXGEDWLSAKEX

TAQ PRO   ....E...........E...A..R....................I................. 833
TFL PRO   ..Q.L...........D..R....W..Q..................L................ 831
TTH PRO   ....R.........L..QA..E......A..KA...................M.......G.. 835
```

```
                                BstBI (382)                                                    NdeI (443)
                                      |        390       400       410       420       430       440       450       460
1 TaqPol                              DPSNTTPEGVARRYGGEWTEEAGERAALSERLRANLWRFRLEGEERLLWLYREVERPLSRVLAHMEATGVRLRDVAYLRALS
2 TthPol                              DPSNTTPEGVARRYGGEWTEDAALRALLSERLRANLLKRRLEGEEKLLWLYHEVEKPLSEVLAHMEATGVRLEDVAYLGALS
                                      +        +         +        ++        ++        +         +         +         +

470       480       490       500       510       520       530       540
1 TaqPol                              LEVAEEIRRLEGEEVFRLAGHPFNLNSRDQLERVLFDELGLPAIGKTEKTGKRSTSAAVLEALREAHPIVEKILQYRELTK
2 TthPol                              LELAEEIARLEGEEVFRLAGHPFNLNSRDQLERVLFDELGLPALGKTEKTGKRSTSAAVLEALREAHPIVEKILQYRELTK
                                      +        +        +         +         +         +         +         +

BamHI (593)
                                      550       560       570       580       590
1 TaqPol                              LKSTYIDPLPDLIHPRTGRLHTRFNQTATATGRLSSSDPNLQNIPVRTPLGQRI
2 TthPol                              LKNTYVDPLPSLVHPRTGRLHTRFNQTATATGRLSSSDPNLQNIPVRTPLGQRI
                                      +        ++       +         +         +
```

FIGURE 13

| | | Polymerase Activity Assays |
|---|---|---|
| | | % Fl-labeled dUTP incorporated |
| Nuclease Domain | Polymerase Domain | RNA, p(A)    or    DNA, p(dA) Template |
| Tth | | 5.8 (1.00)         14.8 (1.00) |
| Taq | | 0.8 (0.14)         15.0 (1.01) |
| TaqTth(N) | | 4.88 (0.84)        12.9 (0.87) |
| TaqTth(N-B) | | 0.58 (0.10)        13.3 (0.90) |
| TaqTth(B-S) | | 6.60 (1.14)        14.9 (1.01) |
| Taq(W417L/G418K/E507Q) | | 0.42 (0.07)        12.6 (0.85) |

FIGURE 16

(SEQ ID NO:224)   (SEQ ID NO:223)

```
                    Fl-C    cy3
                       ↓   C GCT  TCTCGCTCGC  ↓
            ACGGAACGAGCGTCTTTG
            UGCCUUGCUCGCAGAAAGCGACAGAGCGAGCG
                              ↑
```

(SEQ ID NO:225)

FIGURE 18A

```
                                              (SEQ ID NO:223)
     (SEQ ID NO:224)              cy3              ↓
                              Fl-C    /
             ↓                    \C    \
                                    GCT   TCTCGCTCGC
     ACGGAACGAGCGTCTTTG
     TGCCTTGCTCGCAGAAAGCGACAGAGCGAGCG
                              ↑
                        (SEQ ID NO:226)
```

FIGURE 18B

```
                                        (SEQ ID NO:223)
                              cy3
                       Fl-C    / \
                          CGCT    TCTCGCTCGC
            TGCCTTGCTCGCAGAAAGCGACAGAGCGAGCG
                              ↑
                        (SEQ ID NO:226)
```

FIGURE 18D

FIGURE 21
A
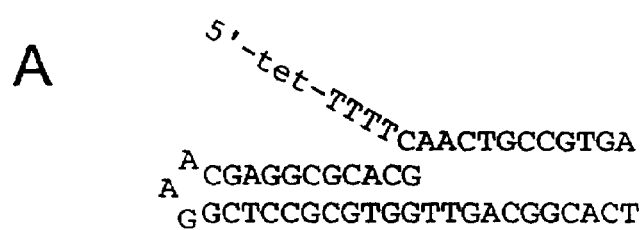
B
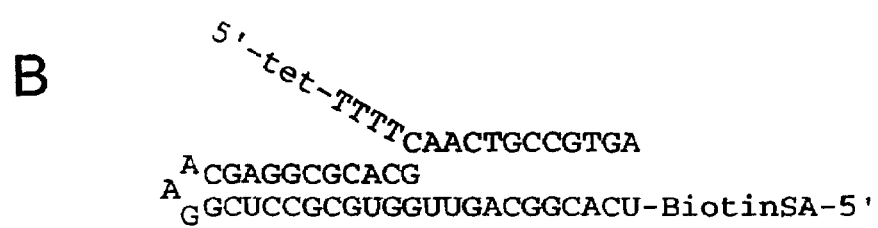

FIGURE 22

(SEQ ID NO:230)

A
↓

3'NH4-AATTGCTCCGCGTGGTTGACGAAGGAGGC-5'
　　　　　　　　　　　　　CAACTGCTTCCTCCG-3'
5'-Fl-TCCTTCT
↑
(SEQ ID NO:231)

(SEQ ID NO:232)

B
↓
　　　　　　　　　　　　　　　　CTCAAATCTCCCTTT-biotin
5'-AACGAGGCGCACC
(SEQ ID NO:230)
↓
3'NH4-AATTGCTCCGCGTGGTTGACGAAGGAGGC-5'
　　　　　　　　　　　　　CAACTGCTTCCTCCG-3'
5'-Fl-TCCTTCT
↑
(SEQ ID NO:231)

FIGURE 24
A
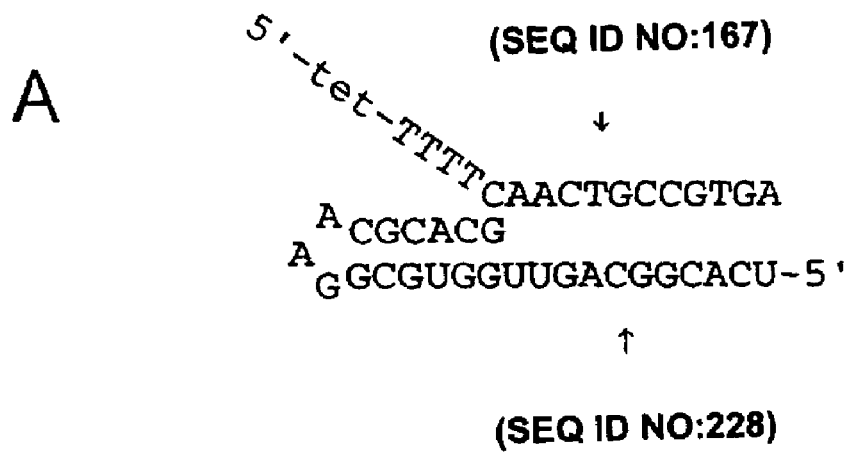
B
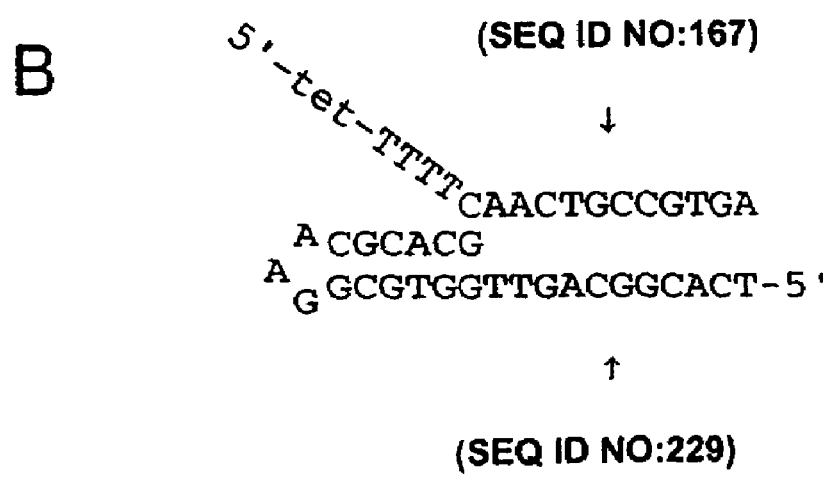

FIGURE 28
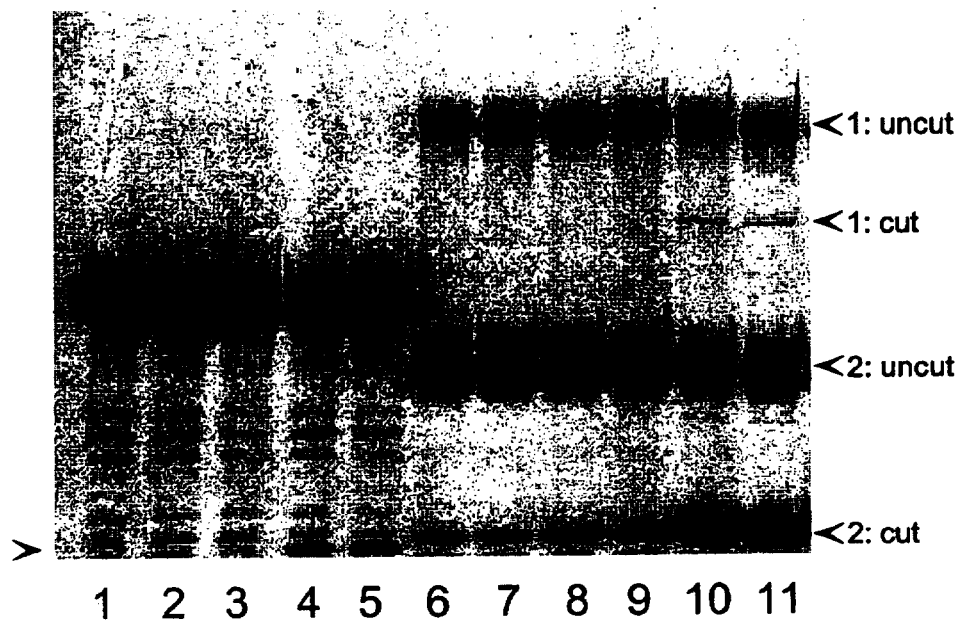
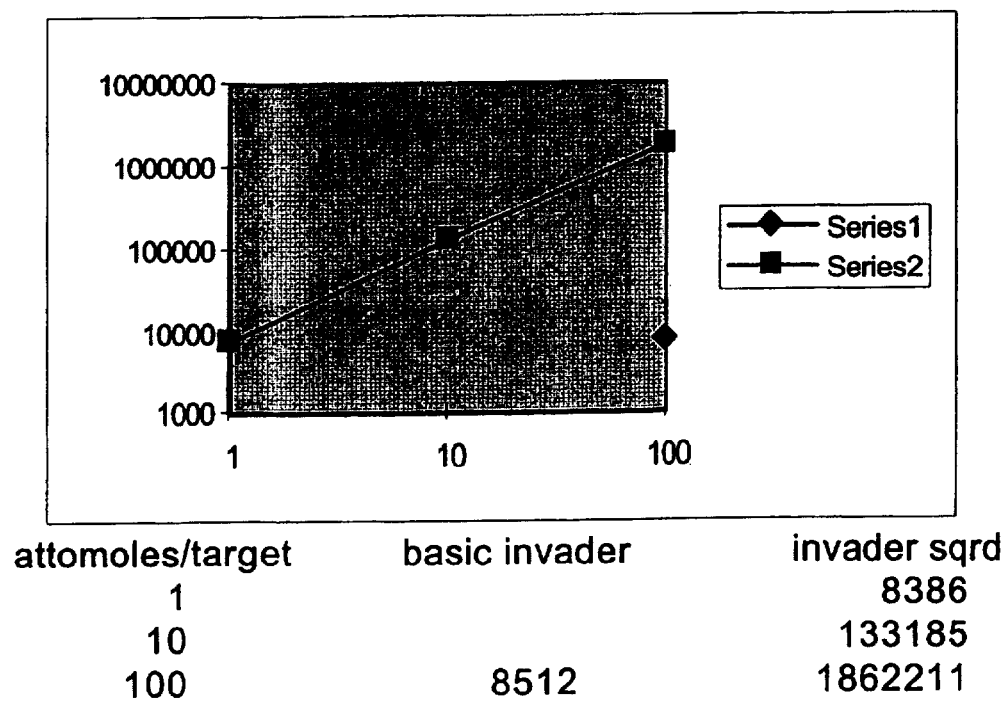
| attomoles/target | basic invader | invader sqrd |
|---|---|---|
| 1 | | 8386 |
| 10 | | 133185 |
| 100 | 8512 | 1862211 |

FIGURE 40

|   | 1 | 2 | 3 | 4 | 5 | 6 | 7 | 8 | 9 | 10 | 11 | 12 |
|---|---|---|---|---|---|---|---|---|---|----|----|----|
| A | Negative Control | No Target Control | Sample 1 | Sample 1 | Sample 9 | Sample 9 | Sample 17 | Sample 17 | Sample 25 | Sample 25 | Sample 33 | Sample 33 |
| B | No Target Control | No Target Control | Sample 2 | Sample 2 | Sample 10 | Sample 10 | Sample 18 | Sample 18 | Sample 26 | Sample 26 | Sample 34 | Sample 34 |
| C | Standard 1 | Standard 1 | Sample 3 | Sample 3 | Sample 11 | Sample 11 | Sample 19 | Sample 19 | Sample 27 | Sample 27 | Sample 35 | Sample 35 |
| D | Standard 2 | Standard 2 | Sample 4 | Sample 4 | Sample 12 | Sample 12 | Sample 20 | Sample 20 | Sample 28 | Sample 28 | Sample 36 | Sample 36 |
| E | Standard 3 | Standard 3 | Sample 5 | Sample 5 | Sample 13 | Sample 13 | Sample 21 | Sample 21 | Sample 29 | Sample 29 | Sample 37 | Sample 37 |
| F | Standard 4 | Standard 4 | Sample 6 | Sample 6 | Sample 14 | Sample 14 | Sample 22 | Sample 22 | Sample 30 | Sample 30 | Sample 38 | Sample 38 |
| G | Standard 5 | Standard 5 | Sample 7 | Sample 7 | Sample 15 | Sample 15 | Sample 23 | Sample 23 | Sample 31 | Sample 31 | Sample 39 | Sample 39 |
| H | Standard 6 | Standard 6 | Sample 8 | Sample 8 | Sample 16 | Sample 16 | Sample 24 | Sample 24 | Sample 32 | Sample 32 | Sample 40 | Sample 40 |

FIGURE 41A hUbiquitin

| | | |
|---|---|---|
| Primary probe | 5'-CGC CGA GAT CAC CTT TAC ATT TTC TAT CGT NH2-3' | (SEQ ID NO:169) |
| INVADER oligonucleotide | 5'-CCT TCC TTA TCC TGG ATC TTG GCA-3' | (SEQ ID NO:170) |
| ARRESTOR oligonucleotide | 5'-ACG ATA GAA AAT GTA AAG GTG ATC-3' | (SEQ ID NO:171) |
| FRET Probe | 5'-RED-CTC (Z28) TTC TCA GTG CG-3' | (SEQ ID NO:172) |
| Secondary target | 5'-CGC AGT GAG AAT GAG GTG ATC TCG GCG GT-3' | (SEQ ID NO:173) | m/r Ubiquitin, mouse (288C, 516C, 744C, 972C), rat (247C, 475C, 703C, 931C)

| | | |
|---|---|---|
| Primary probe | 5'-CCG AGA TCA CGG ATG TTG TAA TCA GAG A-NH2-3' | (SEQ ID NO:174) |
| INVADER oligonucleotide 1 | 5'-GTG CAG GGT TGA CTC CTT CTC-3' | (SEQ ID NO:175) |
| INVADER oligonucleotide 2 | 5'-GTG CAG GGT TGA CTC TTT CTC-3' | (SEQ ID NO:176) |
| INVADER oligonucleotide 3 | 5'-GTG CAG GGT CGA CTC TTT CTC-3' | (SEQ ID NO:177) |
| ARRESTOR oligonucleotide | 5'-TCT GTG ATT ACA ACA TCC GTG ATC T-3' | (SEQ ID NO:178) |
| FRET Probe | 5'-RED-CTC (Z28) TTC TCA GTG CG-3' | (SEQ ID NO:172) |
| Secondary target | 5'-CGC AGT GAG AAT GAG GTG ATC TCG GCG GT-3' | (SEQ ID NO:173) | r/m GAPDH, rat (150C), mouse(166C)

| | | |
|---|---|---|
| Primary probe | 5'-CGC CGA GAT CAC GTA GTT GAG GTC AAT GA-NH2-3' | (SEQ ID NO:179) |
| INVADER oligonucleotide | 5'-GAA TCA TAC TGG AAC ATG TAG ACC ATC-3' | (SEQ ID NO:180) |
| ARRESTOR oligonucleotide | 5'-TCA TTG ACC TCA ACT ACG TGA TCT-3' | (SEQ ID NO:181) |
| FRET Probe | 5'-RED-CTC (Z28) TTC TCA GTG CG-3' | (SEQ ID NO:172) |
| Secondary target | 5'-CGC AGT GAG AAT GAG GTG ATC TCG GCG GT-3' | (SEQ ID NO:173) | hGAPDH, 516C

| | | |
|---|---|---|
| Primary probe | 5'-CCG CCG AGA TCA CGA TGA TCT TGA GGC T-NH2-3' | (SEQ ID NO:182) |
| INVADER oligonucleotide | 5'-TGG TGC AGG AGG CAT TGC TC-3' | (SEQ ID NO:183) |
| ARRESTOR oligonucleotide | 5'-CAG CCT CAA GAT TAC CGT GAT CT-3' | (SEQ ID NO:184) |
| FRET Probe | 5'-RED-CTC (Z28) TTC TCA GTG CG-3' | (SEQ ID NO:172) |
| Secondary target | 5'-CGC AGT GAG AAT GAG GTG ATC TCG GCG GT-3' | (SEQ ID NO:173) |

FIGURE 41B hTGF-β
Primary probe          5'- CCG TCA CGC CTC CTC CAC GGC TC -3'          (SEQ ID NO:185)
INVADER oligonucleotide 5'- AGG CGA AAG CCC TCA ATT TCC CA-3'         (SEQ ID NO:186)
Stacker                5'-AAC CAC TGC CGC ACA-3'                      (SEQ ID NO:187)
ARRESTOR oligonucleotide 5'-GAG CCG TGG AGG AGG CG-3'                 (SEQ ID NO:188)
FRET Probe             5'-FL-CAC-(Z28)-TGC TTC GTG G-3'               (SEQ ID NO:189)
Secondary target       5'-CCA GGA AGC AAG TGG AGG CGT GAC GGT-3'      (SEQ ID NO:190)

hMCP-1
Primary probe          5'-CCG TCA CGC CTC CTT CGG AGT TTG GG NH2 -3"  (SEQ ID NO:191)
INVADER oligonucleotide 5'-GGG TTG TGG AGT GAG TGT TCA AGT A -3'      (SEQ ID NO:192)
Stacker                NO STACKER
ARRESTOR oligonucleotide 5'-GGG-AAA-CTC-CGA-AGG- AGG-CG-3'            (SEQ ID NO:193)
FRET Probe             5'-FL-CAC-Z28-TGC TTC GTG G-3'                 (SEQ ID NO:189)
Secondary target       5'-CCA GGA AGC AAG TGG AGG CGT GAC GGT-3'      (SEQ ID NO:190)

hTNF-α
Primary probe          5'-CCG TCA CGC CTC TCT GAC TGC CA NH2 -3'       (SEQ ID NO:194)
INVADER oligonucleotide 5' -TTG TCA CTC GGG GTT CGA GAA GAT GAA-3'    (SEQ ID NO:195)
Stacker                5'-GGG CCA GAG GG-3'                           (SEQ ID NO:196)
ARRESTOR oligonucleotide 5'-AGG CAG TCA GAG AGG CG-3'                 (SEQ ID NO:197)
FRET Probe             5'-FL-CAC-Z28-TGC TTC GTG G-3'                 (SEQ ID NO:189)
Secondary target       5'-CCA GGA AGC AAG TGG AGG CGT GAC GGT-3'      (SEQ ID NO:190)

hIL-6
Primary probe          5' -CCG TCA CGC CTC CTC CTC ATT GAA TTNH2-3'   (SEQ ID NO:198)
INVADER oligonucleotide 5' -CCA AAA GTC CAG TGA TGA TTT TCA CCA GGC AAG TA -3' (SEQ ID NO:199)
Stacker                5'-CAG ATT GGA AGC ATC CAT CT-3'               (SEQ ID NO:200)
ARRESTOR oligonucleotide 5'-GAT TCA ATG AGG AGG AGG C-3'              (SEQ ID NO:201)
FRET Probe             5'-FL-CAC-(Z28)-TGC TTC GTG G-3'               (SEQ ID NO:189)
Secondary target       5'-CCA GGA AGC AAG TGG AGG CGT GAC GGT-3'      (SEQ ID NO:190)

FIGURE 41C hIL-1β
Primary probe            5'-CCG TCA CGC CTC CAT CTG TTT AGG NH2-3'        (SEQ ID NO:202)
INVADER oligonucleotide  5'-CAG GTC CTG GAA GGA GCA CTT A-3'              (SEQ ID NO:203)
Stacker                  5'-GCC ATC AGC TTC TTT GTT CTT GTC ATC-3'        (SEQ ID NO:204)
ARRESTOR oligonucleotide 5'-GCC CTA AAC AGA TGG AGG CG-3'                 (SEQ ID NO:205)
FRET Probe               5'-FL-CAC-(Z28)-TGC TTC GTG G-3'                 (SEQ ID NO:189)
Secondary target         5'-CCA GGA AGC AAG TGG AGG CGT GAC GGT-3'        (SEQ ID NO:190)

hIL-2
Primary probe            5'-CCG TCA CGC CTC CTC CAG TTG TAG NH2-3'        (SEQ ID NO:206)
INVADER oligonucleotide  5'-AAA ATC ATC TGT AAA TCC AGC AGT AAA TGA-3'    (SEQ ID NO:207)
Stacker                  5'-CTG TGT TTT CTT TGT AGA AC-3'                 (SEQ ID NO:208)
ARRESTOR oligonucleotide 5'-CTA CAA CTG GAG GAG GC-3'                     (SEQ ID NO:209)
FRET Probe               5'-FL-CAC-(Z28)-TGC TTC GTG G-3'                 (SEQ ID NO:189)
Secondary target         5'-CCA GGA AGC AAG TGG AGG CGT GAC GGT-3'        (SEQ ID NO:190)

hIL-8
Primary probe            5'-CCG TCA CGC CTC CTC TCA GTT CT-NH2-3'         (SEQ ID NO:210)
INVADER oligonucleotide  5'-GTG TGG TCC ACT CTC AAT CAA-3'                (SEQ ID NO:211)
Stacker                  5'-TTG ATA AAT TTG GGG TGG AAA GGT TTG GA-3'     (SEQ ID NO:619)
ARRESTOR oligonucleotide 5'-AGA ACT GAG AGG AGG CG-3'                     (SEQ ID NO:620)
FRET Probe               5'-FL-CAC-(Z28)-TGC TTC GTG G-3'                 (SEQ ID NO:189)
Secondary target         5'-CCA GGA AGC AAG TGG AGG CGT GAC GGT-3'        (SEQ ID NO:190)

hIL-10
Primary probe            5'-AAC GAG GCG CAC CAA ACT CAC TCA T-NH2-3'      (SEQ ID NO:621)
INVADER oligonucleotide  5'-GTC ATG TAG GCT TCT ATG TAG TTG ATG AAG ATG TA-3' (SEQ ID NO:622)
Stacker                  5'-GGC TTT GTA GAT GCC TTT CTC TTG GA-3'         (SEQ ID NO:623)
ARRESTOR oligonucleotide 5'-ATG AGT GAG TTT GGT GCG-3'                    (SEQ ID NO:624)
FRET Probe               5'-FL-CAC-(Z28)-TGC TTC GTG G-3'                 (SEQ ID NO:189)
Secondary target         5'-CCA GGA AGC AAG TGG TGC GCC TCG TTT-3'        (SEQ ID NO:625)

FIGURE 41D hIL-4

| | | |
|---|---|---|
| Primary probe | 5'-AAC GAG GCG CAC CTT GGA GGC A-NH2-3' | (SEQ ID NO:626) |
| INVADER oligonucleotide | 5'-AAG GTT TCC TTC TCA GTT GTG TTA-3' | (SEQ ID NO:627) |
| Stacker | 5'-GCA AAG ATG TCT GTT ACG GTC AAC TC-3' | (SEQ ID NO:628) |
| ARRESTOR oligonucleotide | 5'-TGC CTC CAA GGT GCG C-3' | (SEQ ID NO:629) |
| FRET Probe | 5'-FL-CAC (Z28)-TGC TTC GTG G-3' | (SEQ ID NO:189) |
| Secondary target | 5'-CCA GGA AGC AAG TGG TGC GCC TCG TTT-3' | (SEQ ID NO:625) | hIFN-γ

| | | |
|---|---|---|
| Primary probe | 5'-AAC GAG GCG CAC CTT CAA AAT GCC TAA-NH2-3' | (SEQ ID NO:630) |
| INVADER oligonucleotide | 5'-TGT CAC TCT CCT CTT TCC AAT TA-3' | (SEQ ID NO:631) |
| Stacker | 5'-GAA AAG AGT TCC ATT ATC CGC TAC ATC TG-3' | (SEQ ID NO:632) |
| ARRESTOR oligonucleotide | 5'-TTA GGC ATT TTG AAG GTG CGC-3' | (SEQ ID NO:633) |
| FRET Probe | 5'-FL-CAC (Z28)-TGC TTC GTG G-3' | (SEQ ID NO:189) |
| Secondary target | 5'-CCA GGA AGC AAG TGG TGC GCC TCG TTT-3' | (SEQ ID NO:625) |

FIGURE 41E hCYP 1A2, 1193G

| | | |
|---|---|---|
| Primary probe | 5'-AAC GAG GCG CAC CGT TGT GTC CC-NH2-3' | (SEQ ID NO:634) |
| INVADER oligonucleotide | 5'-GGG ATG TAG AAG CCA TTC AGA-3' | (SEQ ID NO:635) |
| Stacker | 5'-TTG TTG TGC TGT GGG GGA TG-3' | (SEQ ID NO:636) |
| ARRESTOR oligonucleotide | 5'-GGG ACA CAA CGG TGC GC-3' | (SEQ ID NO:637) |
| FRET Probe | 5'-FL-CAC (Z28) TGC TTC GTG G-3' | (SEQ ID NO:189) |
| Secondary target | 5'-CCA GGA AGC AAG TGG TGC GCC TCG TTT-3' | (SEQ ID NO:625) | hCYP 2B6, 343G

| | | |
|---|---|---|
| Primary probe | 5'- CCG TCA CGC CTC CAC CAT ATC CC-NH2-3' | (SEQ ID NO:638) |
| INVADER oligonucleotide | 5'-CCA GCG GTT TCC ATT GGC AAA GAT CAA-3' | (SEQ ID NO:639) |
| Stacker | 5'-CGG AAG AAT GGG TCG ACC ATG-3' | (SEQ ID NO:640) |
| ARRESTOR oligonucleotide | 5'-GGG ATA TGG TGG AGG CG-3' | (SEQ ID NO:641) |
| FRET Probe | 5'-FL-CAC (Z28) TGC TTC GTG G-3' | (SEQ ID NO:189) |
| Secondary target | 5'-CCA GGA AGC AAG TGG AGG CGT GAC GGT-3' | (SEQ ID NO:190) | hCYP 2C19, 223G

| | | |
|---|---|---|
| Primary probe | 5'-AAC GAG GCG CAC CGT TCC AGG C-NH2-3' | (SEQ ID NO:642) |
| INVADER oligonucleotide | 5'-CAT ATC CAT GCA GCA CCA CCA TGA-3' | (SEQ ID NO:643) |
| Stacker | 5'-CAA AAT ACA GAG TGA ACA CAG GGC C-3' | (SEQ ID NO:644) |
| ARRESTOR oligonucleotide | 5'-GCC TGG AAC GGT GCG C-3' | (SEQ ID NO:645) |
| FRET Probe | 5'-FL-CAC (Z28) TGC TTC GTG G-3' | (SEQ ID NO:189) |
| Secondary target | 5'-CCA GGA AGC AAG TGG TGC GCC TCG TTT-3' | (SEQ ID NO:625) | hCYP 2C9, 1554T

| | | |
|---|---|---|
| Primary probe | 5'-CCG TCA CGC CTC ATG GAT AAT GCC C-NH2-3' | (SEQ ID NO:646) |
| INVADER oligonucleotide | 5'-CAG GTG AGA AAA GGC ATT ACA GAT AGT GAA AGC-3' | (SEQ ID NO:647) |
| Stacker | 5'-CAG AGG AAA GAG AGC AGC TGC AGG G-3' | (SEQ ID NO:648) |
| ARRESTOR oligonucleotide | 5'-GGG CAT TAT CCA TGA GGC G-3' | (SEQ ID NO:649) |
| FRET Probe | 5'-FL-CAC (Z28) TGC TTC GTG G-3' | (SEQ ID NO:189) |
| Secondary target | 5'-CCA GGA AGC AAG TGG AGG CGT GAC GGT-3' | (SEQ ID NO:190) |

FIGURE 41F hCYP 2D6, 1316G

| | | |
|---|---|---|
| Primary probe | 5'-CCG TCA CGC CTC CCT GCT GAG AAA-NH2-3' | (SEQ ID NO:650) |
| INVADER oligonucleotide | 5'-CCC GAG GCA TGC ACG GCG GA-3' | (SEQ ID NO:651) |
| Stacker | 5'-GGC AGG AAG GCC TCC-3' | (SEQ ID NO:652) |
| ARRESTOR oligonucleotide | 5'-TTT CTC AGC AGG GAG GCG-3' | (SEQ ID NO:653) |
| FRET Probe | 5'-FL-CAC (Z28) TGC TTC GTG G-3' | (SEQ ID NO:189) |
| Secondary target | 5'-CCA GGA AGC AAG TGG AGG CGT GAC GGT-3' | (SEQ ID NO:190) | hCYP 3A4, 309C

| | | |
|---|---|---|
| Primary probe | 5'-CCG TCA CGC CTC GCC CCA CA-NH2-3' | (SEQ ID NO:654) |
| INVADER oligonucleotide | 5'-CAG CAC AGG CTG TTG ACC ATC ATA AAA C-3' | (SEQ ID NO:655) |
| Stacker | 5'-CTT TTC CAT ACT TTT TAT GAC ATT C-3' | (SEQ ID NO:656) |
| ARRESTOR oligonucleotide | 5'-TGT GGG GCG AGG CG-3' | (SEQ ID NO:657) |
| FRET Probe | 5'-FL-CAC (Z28) TGC TTC GTG G-3' | (SEQ ID NO:189) |
| Secondary target | 5'-CCA GGA AGC AAG TGG AGG CGT GAC GGT-3' | (SEQ ID NO:190) | hCYP 3A5 v2, 323T

| | | |
|---|---|---|
| Primary probe | 5'-AAC GAG GCG CAC AGT TGA CCT TC-NH2-3' | (SEQ ID NO:658) |
| INVADER oligonucleotide | 5'-GTG ATG GCC AGC ACA GGG C-3' | (SEQ ID NO:659) |
| Stacker | 5'-ATA CGT TCC CCA CAT TTT TC-3' | (SEQ ID NO:660) |
| ARRESTOR oligonucleotide | 5'-TGA AGG TCA ACT GTG CGC-3' | (SEQ ID NO:661) |
| FRET Probe | 5'-FL-CAC (Z28) TGC TTC GTG G-3' | (SEQ ID NO:189) |
| Secondary target | 5'-CCA GGA AGC AAG TGG TGC GCC TCG TTT-3' | (SEQ ID NO:625) | hCYP 3A7, 231C

| | | |
|---|---|---|
| Primary probe | 5'-AAC GAG GCG CAC GTC ATA AAT ACC CC-NH2-3' | (SEQ ID NO:662) |
| INVADER oligonucleotide | 5'-GCC AGC ATA GGC TGT TGA CAC-3' | (SEQ ID NO:663) |
| Stacker | 5'-AGA CTT TTC TAT ACT TTT TAT AAC ATT C-3' | (SEQ ID NO:664) |
| ARRESTOR oligonucleotide | 5'-GGG GTA TTT ATG ACG TGC GC-3' | (SEQ ID NO:665) |
| FRET Probe | 5'-FL-CAC (Z28) TGC TTC GTG G-3' | (SEQ ID NO:189) |
| Secondary target | 5'-CCA GGA AGC AAG TGG TGC GCC TCG TTT-3' | (SEQ ID NO:625) |

FIGURE 41G h/rCYP 1A1 (human: 937, rat 863G)

| | | |
|---|---|---|
| Primary probe | 5'-CCG TCA CGC CTC CTG TCT GTG AT-NH2-3' | (SEQ ID NO:666) |
| INVADER oligonucleotide (h) | 5'-TCC TGA CAG TGC TCA ATC AGG A-3' | (SEQ ID NO:667) |
| INVADER oligonucleotide (r) | 5'-TCC TGA CAA TGC TCA ATG AGG A-3' | (SEQ ID NO:668) |
| Stacker | 5'-GTC CCG GAT GTG GCC C-3' | (SEQ ID NO:669) |
| ARRESTOR oligonucleotide | 5'-ATC ACA GAC AGG AGG CG-3' | (SEQ ID NO:670) |
| FRET Probe | 5'-FL-CAC (Z28) TGC TTC GTG G-3' | (SEQ ID NO:189) |
| Secondary target | 5'-CCA GGA AGG AAG TGG AGG CGT GAC GGT-3' | (SEQ ID NO:190) | h/rCYP 1A2 (813C/819C)

| | | |
|---|---|---|
| Primary probe | 5'-AAC GAG GCG CAC GGA CTG TTT TCT GC-NH2-3' | (SEQ ID NO:671) |
| INVADER oligonucleotide (h) | 5'-CTT GTC AAA GTC CTG ATA GTG CTC CTC-3' | (SEQ ID NO:672) |
| INVADER oligonucleotide (r) | 5'-CTT GTT GAA GTC TTG ATA GTG TTC CTC-3' | (SEQ ID NO:673) |
| ARRESTOR oligonucleotide | 5'-GCA GAA AAC AGT CCG TGC GC-3' | (SEQ ID NO:674) |
| FRET Probe | 5'-FL-CAC (Z28) TGC TTC GTG G-3' | (SEQ ID NO:189) |
| Secondary target | 5'-CCA GGA AGC AAG TGG TGC GCC TCG TTT-3' | (SEQ ID NO:625) | rCYP 2B1, 1017T

| | | |
|---|---|---|
| Primary probe | 5'-CCG TCA CGC CTC ACT GCG GTC AT-NH2-3' | (SEQ ID NO:675) |
| INVADER oligonucleotide | 5'-GTG GAT AAC TGC ATC AGT GTA TGG CAT TTT C-3' | (SEQ ID NO:676) |
| Stacker | 5'-CAA GGG TTG GTA GCC TGT GTG AGC C-3' | (SEQ ID NO:677) |
| ARRESTOR oligonucleotide | 5'-ATG ACC GCA GTG AGG CG-3' | (SEQ ID NO:678) |
| FRET Probe | 5'-FL-CAC (Z28) TGC TTC GTG G-3' | (SEQ ID NO:189) |
| Secondary target | 5'-CCA GGA AGC AAG TGG AGG CGT GAC GGT-3' | (SEQ ID NO:190) | rCYP 2B2, 162T

| | | |
|---|---|---|
| Primary probe | 5'-CCG TCA CGC CTC AGA GCC AAT CAC-NH2-3' | (SEQ ID NO:679) |
| INVADER oligonucleotide | 5'-CGA TCA TCA AGG GAT GGT GGC CTG TGC-3' | (SEQ ID NO:680) |
| Stacker | 5'-CTG ATC AAT CTC CTT TTG GAC TTT CTC TGC G-3' | (SEQ ID NO:681) |
| ARRESTOR oligonucleotide | 5'-GTG ATT GGC TCT GAG GCG-3' | (SEQ ID NO:682) |
| FRET Probe | 5'-FL-CAC (Z28) TGC TTC GTG G-3' | (SEQ ID NO:189) |
| Secondary target | 5'-CCA GGA AGC AAG TGG AGG CGT GAC GGT-3' | (SEQ ID NO:190) |

FIGURE 41H rCYP 2E1, 969G
| | | |
|---|---|---|
| Primary probe | 5'-CCG TCA CGC CTC CTC TTC AAT TTC TG-NH2-3' | (SEQ ID NO:683) |
| INVADER oligonucleotide | 5'-CCC TGT CAA TTT CTT CAT GAA GTT TA-3' | (SEQ ID NO:684) |
| Stacker | 5'-GGT ATT TCA TGA GGA TCA GGA GTT GC-3'" | (SEQ ID NO:685) |
| ARRESTOR oligonucleotide | 5'-CAG AAA TTG AAG AGG AGG CG-3' | (SEQ ID NO:686) |
| FRET Probe | 5'-FL-CAC (Z28) TGC TTC GTG G-3' | (SEQ ID NO:189) |
| Secondary target | 5'-CCA GGA AGC AAG TGG AGG CGT GAC GGT-3' | (SEQ ID NO:190) | rCYP 3A1, 164G
| | | |
|---|---|---|
| Primary probe | 5'-AAC GAG GCG CAC CGG GTC CCA-NH2-3' | (SEQ ID NO:687) |
| INVADER oligonucleotide | 5'-TCC CCT GTT TCT TGA AAA GTC CAT GTG TGA-3' | (SEQ ID NO:688) |
| Stacker | 5'-AAT CCG TAG AGG AGC ACC AGG-3' | (SEQ ID NO:689) |
| ARRESTOR oligonucleotide | 5'-TGG GAC CCG GTG CGC-3' | (SEQ ID NO:690) |
| FRET Probe | 5'-FL-CAC (Z28) TGC TTC GTG G-3' | (SEQ ID NO:189) |
| Secondary target | 5'-CCA GGA AGC AAG TGG TGC GCC TCG TTT-3' | (SEQ ID NO:625) | rCYP 3A2, 1091G
| | | |
|---|---|---|
| Primary probe | 5'-CCG TCA CGC CTC CTC GGC AGG-NH2-3' | (SEQ ID NO:691) |
| INVADER oligonucleotide | 5'-CAC AAT ATC GTA GGT AGG AGG TGC CTT AA-3' | (SEQ ID NO:692) |
| Stacker | 5'-GCC CCA TCG ATC TCC TCC-3' | (SEQ ID NO:693) |
| ARRESTOR oligonucleotide | 5'-CCT GCC GAG GAG GCG-3' | (SEQ ID NO:694) |
| FRET Probe | 5'-FL-CAC (Z28) TGC TTC GTG G-3' | (SEQ ID NO:189) |
| Secondary target | 5'-CCA GGA AGC AAG TGG AGG CGT GAC GGT-3' | (SEQ ID NO:190) | rCYP 4A1, 296A
| | | |
|---|---|---|
| Primary probe | 5'-AAC GAG GCG CAC TAG GCT TTG CT-NH2-3' | (SEQ ID NO:695) |
| INVADER oligonucleotide | 5'-TTC ATG TAG TCA GGG TCA TAG ACA ATT AAG A-3' | (SEQ ID NO:696) |
| Stacker | 5'-TCC CCA GAA CCA TCG AGG AAA GG-3' | (SEQ ID NO:697) |
| ARRESTOR oligonucleotide | 5'-AGC AAA GCC TAG TGC GC-3' | (SEQ ID NO:698) |
| FRET Probe | 5'-FL-CAC (Z28) TGC TTC GTG G-3' | (SEQ ID NO:189) |
| Secondary target | 5'-CCA GGA AGC AAG TGG TGC GCC TCG TTT-3' | (SEQ ID NO:625) |

FIGURE 41I rCYP 4A2

| | | |
|---|---|---|
| Primary probe | 5'-AAC GAG GCG CAC AGA AGG CCC CTT-NH2-3' | (SEQ ID NO:699) |
| INVADER oligonucleotide | 5'-CCT TGA ACA GCA CCA GAA ATA GAC TGA GCA C-3' | (SEQ ID NO:700) |
| Stacker | 5'-GGA AGA ACC CAG AGA CAC CAT CC-3' | (SEQ ID NO:701) |
| ARRESTOR oligonucleotide | 5'-AAG GGG CCT TCT GTG CGC-3' | (SEQ ID NO:702) |
| FRET Probe | 5'-FL-CAC (Z28) TGC TTC GTG G-3' | (SEQ ID NO:189) |
| Secondary target | 5'-CCA GGA AGC AAG TGG TGC GCC TCG TTT-3' | (SEQ ID NO:625) | rCYP 4A3, 1235C

| | | |
|---|---|---|
| Primary probe | 5'-AAC GAG GCG CAC GTT GTG ATA CCT T-NH2-3' | (SEQ ID NO:703) |
| INVADER oligonucleotide | 5'-GAT GAA GGC CAT AAA TTA AAA TTG TGC-3' | (SEQ ID NO:704) |
| Stacker | 5'-TGG GTA TGG AAC GTC C-3' | (SEQ ID NO:705) |
| ARRESTOR oligonucleotide | 5'-AAG GTA TCA CAA CGT GCG C-3' | (SEQ ID NO:706) |
| FRET Probe | 5'-FL-CAC (Z28) TGC TTC GTG G-3' | (SEQ ID NO:189) |
| Secondary target | 5'-CCA GGA AGC AAG TGG TGC GCC TCG TTT-3' | (SEQ ID NO:625) |

FIG. 47A-1

Oligo sequence descriptions: 5' to 3' direction, 2'-Ome nts are bolded and underlined, internal modifications defined in ( )

| Oligo Type | Oligo Sequence (5' to 3') | Modification | SEQ ID NO |
|---|---|---|---|
| hTNF-α | | | |
| probe | ccg ccg aga tca ctc tga ctg cct NH2 | 3' Amine | 709 |
| invader | ttg tca ctc ggg gtt cga gaa gat gaa | | 710 |
| stacker | ggg cca gag ggc tga tta g | all 2'Ome bases | 711 |
| stacker | ggg cca gag ggc tga tta | all 2'Ome bases | 712 |
| stacker | ggg cca gag ggc tg at | all 2'Ome bases | 713 |
| stacker | ggg cca gag ggc t | all 2'Ome bases | 714 |
| stacker | ggg cca gag gg | all 2'Ome bases | 715 |
| arrestor | agg cag tca gag tga tc | all 2'Ome bases | 716 |
| arrestor | agg cag tca gag tga tct c | all 2'Ome bases | 717 |
| SRT | cggaagaagcagttggtgatctcggcggNH2 | 3' Amine | 718 |
| FRET probe | Fcaac(Cy3)gcttcctccg | | 719 |
| probe | ccg tca cgc ctc tct gac tgc ct NH2 | 3' Amine | 720 |
| invader | ttg tca ctc ggg gtt cga gaa gat gaa | | 721 |
| stacker | ggg cca gag ggc tga tta g | all 2'Ome bases | 722 |
| stacker | agg cag tca gag agg ca | all 2'Ome bases | 723 |
| SRT | cggaagaagcagttggaggcgtgacggtNH2 | 3'base 2'Ome, 3'Amine | 724 |
| FRET probe | Fcaac(Cy3)gcttcctccg | | 725 |
| probe | ccg tca cgc ctc tct gac tgc ctg c NH2 | 3' Amine | 726 |
| invader | ttg tca ctc ggg gtt cga gaa gat gaa | | 727 |
| arrestor | cca ggc agt cag aga ggc g | all 2'Ome bases | 728 |
| SRT | cggaagaagcagttggaggcgtgacggtNH2 | 3'base 2'Ome, 3'Amine | 729 |
| FRET probe | Fcaac(Cy3)gcttcctccg | | 730 |
| probe | ccg ccg aga tca ctc tga ctg cc NH2 | 3' Amine | 731 |
| invader | ttg tca ctc ggg gtt cga gaa gat gaa | | 732 |
| stacker | tgg gcc aga ggg ctg att a | | 733 |
| arrestor | agg cag tca gag tga tc | all 2'Ome bases | 734 |
| SRT | cggaagaagcagttggatctcggcggNH2 | all 2'Ome bases | 735 |
| FRET probe | Fcaac(Cy3)gcttcctccg | 3' Amine | 736 |

FIG. 47A-2

| | | | |
|---|---|---|---|
| probe | ccg ccg aga tca ctg atc tga ctg NH2 | 3' Amine | 737 |
| invader | ctt gtc act cgg ggt tcg aga aga c | | 738 |
| stacker | cct ggg cca gag ggc tga tt | all 2'Ome bases | 739 |
| arrestor | cag tca gat cag tga tc | all 2'Ome bases | 740 |
| SRT | cggaagaagcagttggtgatctcggcggNH2 | 3' Amine | 741 |
| FRET probe | Fcaac(Cy3)gcttcctccg | | 742 |
| probe | ccg tca cgc ctc tct gac tgc ca NH2 | 3' Amine | 743 |
| probe | ccg tca cgc ctc tct gac tgc cg NH2 | 3' Amine | 744 |
| probe | ccg tca cgc ctc tct gac ggc ct NH2 | 3' Amine | 745 |
| probe | ccg tca cgc ctc tct gac agc ct NH2 | 3' Amine | 746 |
| invader | ttg tca ctc ggg gtt cga gaa gat gaa | | 747 |
| stacker | ggg cca gag gcl | all 2'Ome bases | 748 |
| arrestor | agg cag tca gag agg cg | all 2'Ome bases | 749 |
| arrestor | agg ccg tca gag agg cg | all 2'Ome bases | 750 |
| arrestor | agg ctg tca gag agg cg | all 2'Ome bases | 751 |
| SRT | ccaggaagcaagtggaggccgtgacggu | 3' 3bases 2'Ome | 752 |
| FRET probe | Fcaac(Z21)tgcttcgtgg | | 753 |
| probe | ccg aga tca ctc tga tgc ctg gg NH2 | 3' Amine | 754 |
| invader | ctt gtc act cgg ggt tcg aga aga tga a | | 755 |
| arrestor | ccc agg cag tca gag tga tcNH2 | all 2'Ome bases,3' Amine | 756 |
| SRT | cggaggaagcagttggatctcggcggNH2 | 3' 2 last base 2' Ome, 3' Amine | 757 |
| FRET probe | Fcaac(Cy3)gcttcctccg | | 758 |
| hIL-1β | | | |
| probe | ccg tca cgc ctc cat ctg ttt agg g NH2 | 3' Amine | 759 |
| invader | cag gtc ctg gaa gga gca ctt a | | 760 |
| stacker | cca tca gct tct ttg ttc ttg tca tc | all 2'Ome bases | 761 |
| arrestor | gcc cta aac aga tgg agg cg | all 2'Ome bases | 762 |
| SRT | cggaagaagcagttggaggcgtgacggtNH2 | 3'base 2'Ome, 3'Amine | 763 |
| FRET probe | Fcaac(Cy3)gcttcctccg | | 764 |

FIG. 47A-3

| | | | |
|---|---|---|---|
| probe | ccg tca cgc ctc cat ctg ttt agg gc NH2 | 3' Amine | 765 |
| invader | cag gtc ctg gaa gga gca ctt a | | 766 |
| stacker | cat cag ctt ctt tgt tct tgt cat cc | all 2'Ome bases | 767 |
| arrestor | gcc cta aac aga tga agg cg | all 2'Ome bases | 768 |
| SRT | cggaagaagcagttggaggcgtgacggtNH2 | 3'base 2'Ome, 3'Amine | 769 |
| FRET probe | Fcaaac(Cy3)gcttcctccg | | 770 |
| probe | ccg tca cgc ctc cat ctg ttt agg NH2 | 3' Amine | 771 |
| invader | cag gtc ctg gaa gga gca ctt a | | 772 |
| stacker | gcc atc agc ttc ttt gtt ctt gtc atc | all 2'Ome bases | 773 |
| SRT | cggaagaagcagttggaggcgtgacggtNH2 | 3'base 2'Ome, 3'Amine | 774 |
| FRET probe | Fcaaac(Cy3)gcttcctccg | | 775 |
| probe | ccg tca cgc ctc cca tca gct tcNH2 | 3' Amine | 776 |
| invader | gag cac ttc atc tgt tta ggg a | | 777 |
| stacker | ttt gtt ctt gtc atc ctc att gcc ac | all 2'Ome bases | 778 |
| arrestor | gaa gct gat ggg agg cg | all 2'Ome bases | 779 |
| SRT | cggaagaagcagttggaggcgtgacggtNH2 | 3'base 2'Ome, 3'Amine | 780 |
| FRET probe | Fcaaac(Cy3)gcttcctccg | | 781 |
| probe | ccgcgagatcactcatctgttagggccNH2 | 3' Amine | 782 |
| probe | ccgcgagatcactcatctgttagggcNH2 | 3' Amine | 783 |
| invader | caggtcctggaaggagcacta | | 784 |
| arrestor | ggCcctaaacagatgagtgatcNH2 | all 2'Ome bases,3' Amine | 785 |
| SRT | cggaggaagcagttggtgatctcgcggNH2 | 3' 2 last base 2' Ome, 3' Amine | 786 |
| FRET probe | Fcaaac(Cy3)gcttcctccg | | 787 |

| | | | |
|---|---|---|---|
| hcFOS | | | |
| probe | ccg tca cgc ctc cag cag gtt ggc NH2 | 3' Amine | 788 |
| invader | gct tga ccc agg gag gg | | 789 |
| arrestor | gcc aag gtg ctg gag gcg | all 2'Ome bases | 790 |
| SRT | cggaagaagcagttgaggcgtgacggtNH2 | 3'base 2'Ome, 3'Amine | 791 |
| FRET probe | Fcaaac(Cy3)gcttcctccg | | 792 |

FIG. 47A-4

| | | | |
|---|---|---|---|
| probe | ccg tca cgc ctc cag cag gtt gg NH2 | 3' Amine | 793 |
| invader | gct tga ccc agg gag gg | | 794 |
| stacker | caa tct cag tct gca aag cag ac | all 2'Ome bases | 795 |
| arrestor | gcc aag gtg ctg gag gcg | all 2'Ome bases | 796 |
| SRT | cggaagaagcagttggaggcgtgacggtNH2 | 3'base 2'Ome, 3'Amine | 797 |
| FRET probe | Fcaac(Cy3)gcttcctccg | | 798 |
| | | | |
| probe | ccg tca cgc ctc tca gca ggt tgg NH2 | 3' Amine | 799 |
| invader | act cta gtt ttt cct tct a | | 800 |
| stacker | caa tct cag tct gca aag cag ac | all 2'Ome bases | 801 |
| arrestor | cca acc tgc tga gag gcg | all 2'Ome bases | 802 |
| SRT | cggaagaagcagttggaggcgtgacggtNH2 | 3'base 2'Ome, 3'Amine | 803 |
| FRET probe | Fcaac(Cy3)gcttcctccg | | 804 |
| | | | |
| hIL-6 | | | |
| probe | ccg tca cgc aga tca ctc tcc tca ttg aat cct NH2 | 3' Amine | 805 |
| probe | ccg cga aga tca ctc tcc tca ttg aat ccNH2 | 3' Amine | 806 |
| invader | cca aaa gtc cag tga tga ttt tca cca ggc aag a | | 807 |
| stacker | aga att caa tga gga aga gtg atc tNH2 | all 2'Ome bases, 3' Amine | 808 |
| arrestor | cggagaagcagttggtgatctcggcggNH2 | 3' 2 last base 2' Ome, 3' Amine | 809 |
| SRT | Fcaac(Cy3)gcttcctccg | | 810 |
| FRET probe | | | |
| | | | |
| probe | ccg tca cgc ctc ctc ctc att gaaNH2 | 3' Amine | 811 |
| invader | cca gtg atg att ttc acc agg caa gta | | 812 |
| stacker | tcc aga ttg gaa gca tcc atc t | all 2'Ome bases | 813 |
| arrestor | ttc aat gag gag gag gc | all 2'Ome bases | 814 |
| SRT | cggaagaagcagttggaggcgtgacggtNH2 | 3'base 2'Ome, 3'Amine | 815 |
| FRET probe | Fcaac(Cy3)gcttcctccg | | 816 |
| | | | |
| probe | ccg tca cgc ctc ctc ctc att gaNH2 | 3' Amine | 817 |
| invader | cca gtg atg att ttc acc agg caa gta | | 818 |
| stacker | atc cag att gga agc atc cat ct | all 2'Ome bases | 819 |
| arrestor | ttc aat gag gag gag gc | all 2'Ome bases | 820 |
| SRT | cggaagaagcagttggaggcgtgacggtNH2 | 3'base 2'Ome, 3'Amine | 821 |
| FRET probe | Fcaac(Cy3)gcttcctccg | | 822 |

FIG. 47A-5

| Type | Sequence | Modification | # |
|---|---|---|---|
| probe | ccg tca cgc ctc ctc ctc att gaa tgNH2 | 3' Amine | 823 |
| probe | ccg tca cgc ctc ctc ctc att gaa taNH2 | 3' Amine | 824 |
| probe | ccg tca cgc ctc ctc ctc att gaa ttNH2 | 3' Amine | 825 |
| invader | cca aaa gtc cag tga tga ttt tca cca ggc aag ta | | 826 |
| stacker | cagattgaagcatcatct | | 827 |
| arrestor | gattcaatgagnagagc | all 2'Ome bases | 828 |
| SRT | ccaggaagcaagttggaggcgtgacggu | all 2'Ome bases | 829 |
| FRET probe | Fcac(Z21)tgcttcgtgg | 3' 3bases 2'Ome | 830 |
| hMCP-1 | | | |
| probe | ccg tca cgc ctc ctt cgg agt ttg gtNH2 | 3' Amine | 831 |
| probe | ccg tca cgc ctc ctt cgg agt ttg gtt NH2 | 3' Amine | 832 |
| invader | ggg ttg tgg agt gag tgt tca agt a | | 833 |
| arrestor | aac cca aac tcc gaa ggc ggc gtg NH2 | all 2'Ome bases | 834 |
| SRT | cggaagaagcagttggaggcgtgacggtNH2 | 3'base 2'Ome, 3'Amine | 835 |
| FRET probe | Fcaac(Cy3)gcttcctccg | | 836 |
| probe | gcc gtc acg cct ttg gtt tgc ttg tc NH2 | 3' Amine | 837 |
| probe | gcc gtc acg cct ttg gtt tgc ttg tNH2 | 3' Amine | 838 |
| Invader | tggagtgagtgttcaagtctggaga | | 839 |
| arrestor | gacaagcaaacccaaaggccg | all 2'Ome bases | 840 |
| SRT | cggaagaagcagttggaggcgtgacggcNH2 | 3'2 bases 2'Ome, 3'Amine | 841 |
| FRET probe | Fcaac(Cy3)gcttcctccg | | 842 |
| probe | cct gtc tcg ctg cct tcg gag ttt ggg | | 843 |
| probe | cct gtc tcg ctg cct tcg gag ttt gg | | 844 |
| invader | ggg ttg tgg agt gag tgt tca agt a | | 845 |
| arrestor | ccc aaa ctc cga agg cag cg | all 2'Ome bases | 846 |
| SRT | cggaggaagcagttggcagcgagacgagac(Amino dA)ggNH2 | 3' last base 2'Ome, 3' Amine | 847 |
| SRT | cggaggaagcagttggcagcgagcg(Amino dA)gacaggNH2 | Amino dA modification | 848 |
| SRT | cggaggaagcagttggcagcg(Amino dA)gcgagacaggNH2 | Amino dA modification | 849 |
| SRT | cggaggaagcagttggcagcggc(Amono dA)gcgagacaggNH2 | Amino dA modification | 850 |
| SRT | cggaggaagcagttggcagcg(Amino dA)gac(Amino dA)ggNH2 | Amino dA modification | 851 |
| SRT | cggaggaagcagttggct(Amino dA)gcgagagac(Amino dA)ggNH2 | Amino dA modification | 852 |
| SRT | cggaggaagcagttggct(Amino dA)gcg(Amino dA)gacaggNH2 | Amino dA modification | 853 |
| FRET probe | Fcaac(Cy3)gcttcctccg | | 854 |

FIG. 47A-6

| | | | |
|---|---|---|---|
| probe | gcc gtc acg cct ctg gga cac ttg ctg cNH2 | 3' Amine | 855 |
| invader | gcc aca atg gtc ttg aag atc aca gct tct ta | | 856 |
| arrestor | gca gca agt gtc cca gag gcg NH2 | all 2'Ome bases,3' Amine | 857 |
| SRT | cggaagaagcagttggaggcgtgacggcNH2 | 3'2 bases 2'Ome, 3'Amine | 858 |
| FRET probe | Fcaac(Cy3)gcttcctccg | | 859 |
| probe | ccg tca cgc ctc ctt cgg agt ttg gg NH2 | 3' Amine | 860 |
| invader | ggg ttg tgg agt gag tgt tca agt a | | 861 |
| arrestor | 5'-ggg-aaa-ctc-cga-agg- agg-cg-3' | all 2'Ome bases | 862 |
| SRT | ccaggaagcaagtggaggcgtgacggu | 3' 3bases 2'Ome | 863 |
| FRET probe | Fcac(221)tgcttcgtgg | | 864 |
| probe | cgc cga gat cac ctt cgg agt ttg gg NH2 | 3' Amine | 865 |
| invader | ggg ttg tgg agt gag tgt tca agt a | | 866 |
| arrestor | ccc aaa ctc cga agg tga tc | all 2'Ome bases | 867 |
| SRT | cggaagaagcagttggtgatctcggcggNH2 | 3' Amine | 868 |
| FRET probe | Fcaac(Cy3)gcttcctccg | | 869 |
| probe | aac gag gcg cac ctt cgg agt ttg gg NH2 | 3' Amine | 870 |
| invader | ggg ttg tgg agt gag tgt tca agt a | | 871 |
| arrestor | ccc aaa ctc cga agg tgc g | all 2'Ome bases | 872 |
| SRT | cggaagaagcagttggtgcgcctcattaaNH2 | 3' last 5 bases 2'Ome, 3' Amine | 873 |
| FRET probe | Fcaac(Cy3)gcttcctccg | | 874 |
| probe | ccg tca cgc ctc ctt cgg agt ttg g NH2 | 3' Amine | 875 |
| invader | ggg ttg tgg agt gag tgt tca agt a | | 876 |
| stacker | gtt tgc ttg tcc agg tgg | all 2'Ome bases | 877 |
| arrestor | cca aac tcc gaa gga ggc g | all 2'Ome bases | 878 |
| SRT | cggaagaagcagttggaggcgtgacgggtNH2 | 3'base 2'Ome, 3'Amine | 879 |
| FRET probe | Fcaac(Cy3)gcttcctccg | | 880 |
| probe | ccg tca cgc ctc ctt cgg agt ttg NH2 | 3' Amine | 881 |
| invader | ggg ttg tgg agt gag tgt tca agt a | | 882 |
| stacker | gtt ttg ctt gtc cag gtg g | all 2'Ome bases | 883 |
| arrestor | cca aac tcc gaa gga ggc g | all 2'Ome bases | 884 |
| SRT | cggaagaagcagttggaggcgtgacgggtNH2 | 3'base 2'Ome, 3'Amine | 885 |

FIG. 47A-7

| | | | |
|---|---|---|---|
| FRET probe | Fcaac(Cy3)gcttcctccg | | 886 |
| | | | |
| probe | ccg tca cgc ctc ctt cgg agt ttNH2 | 3' Amine | 887 |
| invader | ggg ttg tgg agt gag tgt tca agt a | | 888 |
| stacker | ggg ttt gct tgt cca ggt g | all 2'Ome bases | 889 |
| arrestor | cca aac tcc gaa gga ggc g | all 2'Ome bases | 890 |
| SRT | cggagaagcagttggaggcgtgacggtNH2 | 3'base 2'Ome, 3'Amine | 891 |
| FRET probe | Fcaac(Cy3)gcttcctccg | | 892 |
| | | | |
| probe | ccgtcacgcctccggagtttgggNH2 | 3' Amine | 893 |
| invader | gtt gtg gag tga gtg ttc aag tat ta | | 894 |
| stacker | ttt gct tgt cca ggt ggt cca g | all 2'Ome bases | 895 |
| arrestor | ccc aaa ctc cgg agg cg | all 2'Ome bases | 896 |
| SRT | cggagaagcagttggaggcgtgacggtNH2 | 3'base 2'Ome, 3'Amine | 897 |
| FRET probe | Fcaac(Cy3)gcttcctccg | | 898 |
| | | | |
| probe | cgc cga gat cac cgg agt ttg ggNH2 | 3' Amine | 899 |
| invader | gtt gtg gag tga gtg ttc aag tat ta | | 900 |
| stacker | ttt gct tgt cca ggt ggt cca g | all 2'Ome bases | 901 |
| arrestor | cta gtg gcc tca aac cc | all 2'Ome bases | 902 |
| SRT | cggagaagcagttggatctcggcggNH2 | 3' Amine | 903 |
| FRET probe | Fcaac(Cy3)gcttcctccg | | 904 |
| | | | |
| hUbiquitin | | | |
| probe | cgc cga gat cac ctt tac att ttc tat cgt | | 905 |
| probe | cgc cga gat cac ctt tac att ttc tat cgt NH2 | | 906 |
| invader | 5' –cct tcc tta tcc tgg atc ttg gca -3' | | 907 |
| stacker | acg ata gaa aat gta aag gtg atc | | 908 |
| SRT | 5'-cgc agt gag aat gag gtg atc tcg gcggt-3' | 3' Amine | 909 |
| FRET probe | 5'-Red-ctc-ZZ1-ttc tca gtg cg-3' | all 2'Ome bases 3' last 3 bases 2'Ome | 910 |

FIG. 47A-8

| | | | |
|---|---|---|---|
| hIL-2 | | | |
| probe | gtttctttgtgtctccgcactgccNH2 | 3' Amine | 911 |
| invader | cca gca gta aat gct cca gtt gta ga | | 912 |
| stacker | tag aac ttg aag tag gta c | all 2'Ome bases | 913 |
| arrestor | caa aga aaa cac agg agg c | all 2'Ome bases | 914 |
| SRT | ccaggaagcaagtggaggcgtgacggu | 3' 3bases 2'Ome | 915 |
| FRET probe | Fcac(Z21)tgcttcgtgg | | 916 |
| | | | |
| probe | aac gag gcg cac ctg tgt ttt ctt tg NH2 | 3' Amine | 917 |
| invader | cca gca gta aat gct cca gtt gta ga | | 918 |
| stacker | tag aac ttg aag tag gta c | all 2'Ome bases | 919 |
| arrestor | caa aga aaa cac agg tgc g | all 2'Ome bases | 920 |
| SRT | ccaggaagcaagtggcgcctcgttt | 3' last 3 bases 2'Ome | 921 |
| FRET probe | Fcac(Z21)tgcttcgtgg | | 922 |
| | | | |
| probe | ccg tca cgc ctc ctc cag ttg tag | 3' Amine | 923 |
| invader | aaa atc atc tgt aaa tcc agc agt aaa tga | 5' 6 bases 2'Ome | 924 |
| stacker | ctg tgt ttt ctt tgt aga ac | all 2'Ome bases | 925 |
| arrestor | cta caa ctg gag gcg gc | all 2'Ome bases | 926 |
| SRT | ccaggaagcaagtggaggcgtgacggu | 3' 3bases 2'Ome | 927 |
| FRET probe | Fcac(Z21)tgcttcgtgg | | 928 |
| | | | |
| probe | aac gag gcg cac ctc cag ttg tag NH2 | 3' Amine | 929 |
| invader | aaa atc atc tgt aaa tcc agc agt aaa tga | 5' 6 bases 2'Ome | 930 |
| stacker | ctg tgt ttt ctt tgt aga ac | all 2'Ome bases | 931 |
| arrestor | cta caa ctg gag gtg cg | all 2'Ome bases | 932 |
| SRT | ccaggaagcaagtggcgcctcgttt | 3' last 3 bases 2'Ome | 933 |
| FRET probe | Fcac(Z21)tgcttcgtgg | | 934 |
| | | | |
| probe | ccg tca cgc ctc ctg tgt ttt ctt tgt aNH2 | 3' Amine | 935 |
| invader | gta aat cca gca gta aat gct cca gtt gta ga | | 936 |
| stacker | gaa ctt gaa gta ggt gca ctg tt | all 2'Ome bases | 937 |
| arrestor | tacaaagaaaaacacaggaggcgtNH2 | all 2'Ome bases, 3' amine | 938 |
| SRT | ccaggaagcaagtggaggcgtgacggu | 3' 3bases 2'Ome | 939 |
| FRET probe | Fcac(Z21)tgcttcgtgg | | 940 |
| | | | |
| probe | aac gag gcg cac ctg tgt ttt ctt tgt aNH2 | 3' Amine | 941 |

FIG. 47A-9

| | | | |
|---|---|---|---|
| invader | gta aat cca gca gta aat gct cca gtt gta ga | | 942 |
| stacker | gaa ctt gaa gta ggt gca ctg tt | all 2'Ome bases | 943 |
| arrestor | tac aaa gaa aac aca ggt gca | all 2'Ome bases | 944 |
| SRT | ccaggaagcaagtggtgcgcctcgttt | 3' last 3 bases 2'Ome | 945 |
| FRET probe | Fcaac(Z21)tgcttcgtgg | | 946 |
| | | | |
| probe | ccg tca cgc ctc ctc cag ttg taa NH2 | 3' Amine | 947 |
| probe | ccg tca cgc ctc ctc cag ttg tat NH2 | 3' Amine | 948 |
| probe | ccg tca cgc ctc ctc cag ttg tac NH2 | 3' Amine | 949 |
| invader | aaa atc atc tgt aaa tcc agc agt aaa tga | 5' 6 bases 2'Ome | 950 |
| stacker | ctg tgt ttt ctt tgt aga ac | all 2'Ome bases | 951 |
| arrestor | cta caa ctg gag gag gc | all 2'Ome bases | 952 |
| SRT | ccaggaagcaagtggaggcgtgacggu | 3' 3bases 2'Ome | 953 |
| FRET probe | Fcaac(Z21)tgcttcgtgg | | 954 |
| | | | |
| probe | gcc gtc acg cct ccc ttc ttg atg NH2 | 3' Amine | 955 |
| invader | ttc tag aca ctg aag atg ttt cag ttc tgt gga | | 956 |
| arrestor | cat gcc caa gga gga aga cg NH2 | all 2'Ome bases, 3' Amine | 957 |
| SRT | cggagaagcagttggaggcgtgacggcNH2 | 3'2 bases 2'Ome, 3'Amine | 958 |
| FRET probe | Fcaac(Cy3)gcttcctccg | | 959 |
| | | | |
| probe | ccg tca cgc ctc taa ttc cat tca aaa tca tct NH2 | 3' Amine | 960 |
| invader | cat cct ggt gag ttt ggg att ctt gta att tat a | | 961 |
| stacker | gta aat cca gca gta aat gct cca gNH2 | all 2'Ome bases, 3' Amine | 962 |
| arrestor | aga tga ttt tga atg gaa tta gag gcg NH2 | all 2'Ome bases, 3' Amine | 963 |
| SRT | cggaagaagcagttggaggcgtgacggcNH2 | 3'2 bases 2'Ome, 3'Amine | 964 |
| FRET probe | Fcaac(Cy3)gcttcctccg | | 965 |
| | | | |
| probe | ccg cca aga tca cct gtg ttt tct ttg ta | | 966 |
| invader | gta aat cca gca gta aat gct cca gtt gta ga | | 967 |
| stacker | gaa ctt gaa gta ggt gca ctg tt | | 968 |
| stacker | gaa ctt gaa gta ggt gca ctg tt | | 969 |
| stacker | gaa ctt gaa gta ggt gca ctg tt | All 2' Ome | 970 |
| stacker | gaa ctt gaa gta ggt gca ctg tt | 5' 3bases 2'Ome | 971 |
| arrestor | tac aaa gaa aac aca ggt gat ct | 5' 6bases 2'Ome | 972 |
| SRT | cggaggaagcagttggtgatctcggcagNH2 | All 2' Ome | 973 |
| FRET probe | Fcaac(Cy3)gcttcctccg | 3' 2 last base 2' Ome, 3' Amine | 974 |

FIG. 47A-10

| | | | |
|---|---|---|---|
| probe | aac gag gcg cac cct tct tgg gca tgNH2 | 3' Amine | 975 |
| invader | ttc tag aca ctg aag atg ttt cag ttc tgt gga | | 976 |
| arrestor | cat gcc caa gaa ggg tgc gNH2 | all 2'Ome bases | 977 |
| SRT | cggaagaagcagttggtgcgcctcgttaaNH2 | 3' last 5 bases 2'Ome, 3' Amine | 978 |
| FRET probe | Fcaac(Cy3)gcttcctccg | | 979 |
| probe | aac gag gcg cac taa ttc cat tca aaa tca tct | | 980 |
| invader | cat cct ggt gag ttt ggg att ctt gta att tat a | | 981 |
| stacker | gta aat cca gca gta aat gct cca gNH2 | all 2'Ome bases, 3' Amine | 982 |
| arrestor | aga tga ttt tga atg gaa tta gtg gt NH2 | all 2'Ome bases, 3' Amine | 983 |
| SRT | cggaagaagcagttggtgcgcctcgttaaNH2 | 3' last 5 bases 2'Ome, 3' Amine | 984 |
| FRET probe | Fcaac(Cy3)gcttcctccg | | 985 | hIL-4

| | | | |
|---|---|---|---|
| probe | cct gtc tcg ctg cca gtt gtg ttc ttg gag NH2 | 3' Amine | 986 |
| invader | ccc tgc aga agg ttt cct tct a | | 987 |
| invader | ccc tgc aga tgg ttt cct tct a | | 988 |
| arrestor | ctc caa gaa cac cac tgg caa cag cNH2 | all 2'Ome bases, 3' Amine | 989 |
| arrestor | ctc caa gaa cac aac tgg cag cag cga NH2 | all 2'Ome bases, 3' Amine | 990 |
| arrestor | ctc caa gaa cac aac tgg cag cga gaNH2 | all 2'Ome bases, 3' Amine | 991 |
| SRT | cggaggaagcagttggcagcgagacaggNH2 | 3' last base 2'Ome, 3' Amine | 992 |
| FRET probe | Fcaac(Cy3)gcttcctccg | | 993 |
| probe | aac gag gcg cac ctt gga ggc agc aaa NH2 | 3' Amine | 994 |
| probe | aac gag gcg cac ctt gga ggc agc aaNH2 | 3' Amine | 995 |
| arrestor | aag gtt tcc ttc tca gtt gtg tta | | 996 |
| arrestor | ctt tgc tgc ctc caa ggt gcg NH2 | all 2'Ome bases, 3' Amine | 997 |
| SRT | cggaggaagcagttggtgcgcctcgttaa NH2 | 3' last 5 bases 2'Ome, 3' Amine | 998 |
| FRET probe | Fcaac(Cy3)gcttcctccg | | 999 |
| probe | cag tca cgt ctc tgg agg cag caa aga tg NH2 | 3' Amine | 1000 |
| invader | aag gtt tcc ttc tca gtt gtg ttc ta | | 1001 |
| arrestor | cat ctt tgc tgc ctc cag aga cg NH2 | all 2'Ome bases, 3' Amine | 1002 |
| SRT | gctactgagatgaaggaagacgtgactgtaNH2 | 3' Amine | 1003 |
| FRET probe | Fcttc(Cy3)tctcagtagc | | 1004 |

FIG. 47A-11

| | | | |
|---|---|---|---|
| probe | aac gag gcg cac ctt gga ggc agc aaa g NH2 | 3' Amine | 1005 |
| invader | aag gtt tcc ttc tca gtt gtg tta | | 1006 |
| arrestor | ctt tgc tgc ctc caa agt gcg NH2 | all 2'Ome bases,3' Amine | 1007 |
| SRT | cggaggaagcagttggtgcgcctcgttaa | 3' last 5 bases 2'Ome | 1008 |
| FRET probe | Fcaac(Cy3)gcttcctccg | | 1009 | mIL-2
| | | | |
|---|---|---|---|
| probe | cgc cga gat cac ccc ttt agt ttt aca aca gtNH2 | 3' Amine | 1010 |
| invader | gaa ttg gca ctc aaa tgt gtt gtc aga ga | | 1011 |
| arrestor | act gtt gta aaa cta aag ggg gtg NH2 | all 2'Ome bases,3' Amine | 1012 |
| SRT | cggaggaagcggttggtgatctcggcgNH2 | 3' last two bases are 2' Ome , 3' Amine | 1013 |
| FRET probe | Fcaac(Cy3)gcttcctccg | | 1014 |

| | | | |
|---|---|---|---|
| probe | tgc cgc cga gat cac ccc ttt agt ttt aca aca gtNH2 | 3' Amine | 1015 |
| invader | gaa ttg gca ctc aaa tgt gtt gtc aga ga | | 1016 |
| arrestor | act gtt gta aaa cta aag ggg gtg NH2 | all 2'Ome bases,3' Amine | 1017 |
| arrestor | act gtt gta aaa cta aag ggg gtg at NH2 | all 2'Ome bases,3' Amine | 1018 |
| arrestor | act gtt gta aaa cta aag ggg gtg at ctNH2 | all 2'Ome bases,3' Amine | 1019 |
| arrestor | act gtt gta aaa cta aag ggg gtg at ctcaNH2 | all 2'Ome bases,3' Amine | 1020 |
| SRT | cggaggaagcggttggtgatctcggcggcaNH2 | 3' Last 2bases 2'Ome, 3' Amine | 1021 |
| FRET probe | Fcaac(Cy3)gcttcctccg | | 1022 |

| | | | |
|---|---|---|---|
| probe | gc cgc cga gat cac ccc ttt agt ttt aca aca gtNH2 | 3' Amine | 1023 |
| probe | c cgc cga gat cac ccc ttt agt ttt aca aca gtNH2 | 3' Amine | 1024 |
| invader | gaa ttg gca ctc aaa tgt gtt gtc aga ga | | 1025 |
| arrestor | act gtt gta aaa cta aag ggg gtg at NH2 | all 2'Ome bases,3' Amine | 1026 |
| SRT | cggaggaagcggttggtgatctcggcggcaNH2 | 3' Last 2bases 2'Ome, 3' Amine | 1027 |
| FRET probe | Fcaac(Cy3)gcttcctccg | | 1028 |

| | | | |
|---|---|---|---|
| probe | aac gag gcg cac ccc ttt agt ttt aca aca gt NH2 | 3' Amine | 1029 |
| invader | gaa ttg gca ctc aaa tgt gtt gtc aga ga | | 1030 |
| arrestor | agtaactgttgtaaaactaaagggggtgcg | | 1031 |
| SRT | cggaggaagcagttggtgcgcctcgttaa | all 2'Ome bases,3' Amine | 1032 |
| FRET probe | Fcaac(Cy3)gcttcctccg | 3' last 5 bases 2'Ome | 1033 |

FIG. 47A-12

| | | | |
|---|---|---|---|
| probe | aac gag gcg cac ccc ttt agt ttt aca aca gt NH2 | 3' Amine | 1034 |
| invader | gaa ttg gca ctc aaa tgt gtt gtc aga ga | | 1035 |
| arrestor | agt aac tgt tgt aaa act aaa ggg gtg cg NH2 | all 2'Ome bases, 3' Amine | 1036 |
| SRT | cggagaagcagttggtgcgcctcgttaa | 3' last 5 bases 2'Ome | 1037 |
| FRET probe | Fcaac(Cy3)gcttcctccg | | 1038 |
| | | | |
| probe | ccgtcaagcctcccttagtttacaaacNH2 | 3' Amine | 1039 |
| invader | gaa ttg gca ctc aaa tgt gtt gtc aga ga | | 1040 |
| stacker | agt tac tct gat att gct gat gaa att ctc ag | | 1041 |
| arrestor | gttgtaaaactaaaggggaggcg | all 2'Ome bases, | 1042 |
| SRT | cggaagaagcagttggaggcgtgacggtNH2 | all 2'Ome bases, | 1043 |
| FRET probe | Fcaac(Cy3)gcttcctccg | 3'base 2'Ome, 3'Amine | 1044 |
| | | | |
| probe | cgtccagatcaccccttagtttacaaacNH2 | 3' Amine | 1045 |
| invader | gaa ttg gca ctc aaa tgt gtt gtc aga ga | | 1046 |
| stacker | agt tac tct gat att gct gat gaa att ctc ag | | 1047 |
| arrestor | gttgtaaaactaaaggggatgatc | All 2'Ome | 1048 |
| SRT | cggagaagcagttggtgatctcggcggNH2 | All 2'Ome | 1049 |
| FRET probe | Fcaac(Cy3)gcttcctccg | 3' Amine | 1050 |
| | | | |
| probe | ccgtcaagcctccccttagtttacaaNH2 | 3' Amine | 1051 |
| invader | gaa ttg gca ctc aaa tgt gtt gtc aga ga | | 1052 |
| stacker | cagttactctgatattgctgatgaaattctca | All 2'Ome | 1053 |
| arrestor | gttgtaaaactaaagggagcg | All 2'Ome | 1054 |
| SRT | cggaagaagcagttggaggcgtgacggtNH2 | 3'base 2'Ome, 3'Amine | 1055 |
| FRET probe | Fcaac(Cy3)gcttcctccg | | 1056 |
| | | | |
| probe | ccgtcaagcctccccttagtttacaaNH2 | 3' Amine | 1057 |
| invader | gaa ttg gca ctc aaa tgt gtt gtc aga ga | | 1058 |
| stacker | cagttactctgatattgctgatgaaattctca | All 2'Ome | 1059 |
| arrestor | gttgtaaaactaaagggagcg | All 2'Ome | 1060 |
| SRT | ccaggaagcagtggaggcgtgacggtNH2 | 3' 2 bases 2'Ome, 3'Amine | 1061 |
| FRET probe | Fcaac(Cy3)gcttcgtgg | | 1062 |

FIG. 47A-13

| | | | |
|---|---|---|---|
| mIL-10 | | | |
| probe | ccg tca cgc ctc ccg tta gct aag at NH2 | 3' Amine | 1063 |
| invader | cga ggt gtt cca agg agt tgt tta | | 1064 |
| stacker | ccc tgg atc aga ttt aga gag c | all 2'Ome bases, | 1065 |
| arrestor | atc tta gct aac ggg acg cg | all 2'Ome bases, | 1066 |
| SRT | cggaagaagcagttggaggcgtgacggtNH2 | 3'base 2'Ome, 3'Amine | 1067 |
| FRET probe | Fcaac(Cy3)gcttcctccg | | 1068 |
| | | | |
| probe | ccg tca cgc ctc agt tgt ttc cgt tNH2 | 3' Amine | 1069 |
| invader | aga ggt aca aac gag gtt ttc caa ggc | | 1070 |
| stacker | agc taa gat ccc tgg atc aga ttt aga ga | all 2'Ome bases, | 1071 |
| arrestor | aac gga aac aac tga ggc g | all 2'Ome bases, | 1072 |
| SRT | ccaggaagcaagtggaggcgtgacggu | 3' 3bases 2'Ome | 1073 |
| FRET probe | Fcaac(Z21)tgcttcgtgg | | 1074 |
| | | | |
| probe | ccg tca cgc ctc ccg tta gct aNH2 | 3' Amine | 1075 |
| invader | caa acg agg ttt tcc aag gag ttg a | | 1076 |
| stacker | aga tcc ctg gat cag att tag aga gct c | all 2'Ome bases, | 1077 |
| arrestor | tag cta acg gaa aga ggc g | all 2'Ome bases, | 1078 |
| SRT | ccaggaagcaagtggaggcgtgacggu | 3' 3bases 2'Ome | 1079 |
| FRET probe | Fcaac(Z21)tgcttcgtgg | | 1080 |
| | | | |
| probe | ccg tca cgc ctc ccg tta gNH2 | 3' Amine | 1081 |
| invader | aga ggt aca aac gag gtt ttc caa gga ga | | 1082 |
| stacker | cta aga tcc ctg gat cag att tag aga g | All 2'Ome | 1083 |
| arrestor | ctaacggaaacaagaggcg | All 2'Ome | 1084 |
| SRT | ccaggaagcaagtggaggcgtgacggu | 3' 3bases 2'Ome | 1085 |
| FRET probe | Fcaac(Z21)tgcttcgtgg | | 1086 |
| | | | |
| hIFN-γ | | | |
| probe | aac gag gcg cac ctt acc aat gcc taa gaa aag agt tNH2 | 3' Amine | 1087 |
| invader | tgc att att ttt ctg tca ctc tcc tct ttc caa tta | | 1088 |
| arrestor | aac tct ttt ctt agg cat ttt gaa ggt gcg NH2 | all 2'Ome bases,3' Amine | 1089 |
| SRT | cggaggaagcagttgtgtcgcctcgttaaNH2 | 3' last 5 bases 2'Ome | 1090 |
| FRET probe | Fcaac(Cy3)gcttcctccg | | 1091 |

FIG. 47A-14

| | | | |
|---|---|---|---|
| probe | cag tca cgt ctc tct tca aaa tgc cta aga aaa gag tNH2 | 3' Amine | 1092 |
| invader | tct gca tta ttt ttc tgt cac tct cct ctt tcc aat a | | 1093 |
| arrestor | act ctt ttc tta ggc att ttg aag aga gac gNH2 | all 2'Ome bases, 3' Amine | 1094 |
| SRT | gctactgagatgaaggagacgtgactgtaNH2 | all 2'Ome bases, 3' Amine | 1095 |
| FRET probe | Fcttc(Cy3)tctcagtagc | | 1096 | mIFN-γ

| | | | |
|---|---|---|---|
| probe | aac gag gcg cac cct ttt gcc agt tcc NH2 | 3' Amine | 1097 |
| invader | gct ctg cag gat ttt cat gtc acc ata | | 1098 |
| arrestor | gag gaa ctg gca aaa ggg tgc gNH2 | all 2'Ome bases, 3' Amine | 1099 |
| SRT | gctactgagatgaaggagacgtgactgtaNH2 | all 2'Ome bases, 3' Amine | 1100 |
| FRET probe | Fcttc(Cy3)tctcagtagc | | 1101 |
| probe | aac gag gcg cac cct ttt gcc agt NH2 | 3' Amine | 1102 |
| invader | gct ctg cag gat ttt cat gtc acc ata | | 1103 |
| stacker | tcc tcc aga tat cca aga aga gac tc | | 1104 |
| arrestor | act ggc aaa agg cgg gc | all 2'Ome bases | 1105 |
| SRT | cgg agg aaag cag ttg gtg cgc ctc guu aa NH2 | 3' last 5 bases 2'Ome | 1106 |
| SRT | cgg aaag cag ttg gtg cgc ctc guu aa NH2 | 3' last 5 bases 2'Ome | 1107 |
| FRET probe | Fcaac(Cy3)gcttcctccg | | 1108 |
| probe | gcc gca cgc cgc ctt ttg cca gt NH2 | 3' Amine | 1109 |
| invader | gct ctg cag gat ttt cat gtc acc ata | | 1110 |
| stacker | tcc tcc aga tat cca aga aga gac tc | | 1111 |
| arrestor | act ggc aaa agg cgg gc | all 2'Ome bases | 1112 |
| SRT | cgg agg aag cag ttg cgg cgt gcg gca NH2 | all 2'Ome bases | 1113 |
| FRET probe | Fcaac(Cy3)gcttcctccg | | 1114 |
| probe | aac gag gcg cac cct ttt gcc agt tc NH2 | 3' Amine | 1115 |
| invader | gct ctg cag gat ttt cat gtc acc ata | | 1116 |
| stacker | ctc cag ata tcc aag aag aga ctc | | 1117 |
| arrestor | gaa ctg gca aaa ggg tgc g | all 2'Ome bases | 1118 |
| SRT | cggaggaagcagttggtgcgcctcgttaaNH2 | all 2'Ome bases | 1119 |
| FRET probe | Fcaac(Cy3)gcttcctccg | 3' last5 bases 2'Ome | 1120 |

FIG. 47A-15

| | | | |
|---|---|---|---|
| hIL-8 | | | |
| probe | ccg tca cgc ctc ctt ggc aaa act gca ccNH2 | 3' Amine | 1121 |
| probe | ccg tca cgc ctc ctt ggc aaa act gca cca NH2 | 3' Amine | 1122 |
| invader | ctt tat gca ctg aca tct aag ttc ttt agc act ca | | 1123 |
| arrestor | tgg tgc agt ttt gcc aag gag gcg NH2 | all 2'Ome bases,3' Amine | 1124 |
| arrestor | tgg tgc agt ttt gcc aag gag gcg tg NH2 | all 2'Ome bases,3' Amine | 1125 |
| SRT | cggagaagcagttggaggcgtgacggcNH2 | 3'2 bases 2'Ome, 3'Amine | 1126 |
| FRET probe | Fcaac(Cy3)gcttcctccg | | 1127 |
| probe | ccg tca cgc ctc cat ctt cac tga ttc ttg gNH2 | 3' Amine | 1128 |
| probe | ccg tca cgc ctc cat ctt cac tga ttc ttg gaNH2 | 3' Amine | 1129 |
| invader | agt gtt gaa gta gat ttg ctt gaa gtt tca ctg ga | | 1130 |
| stacker | gat acc aca gag aat cag tttt | all 2'Ome bases | 1131 |
| arrestor | tcc agg aat cag tga aga tgg agg cg NH2 | all 2'Ome bases,3' Amine | 1132 |
| arrestor | tcc agg aat cag tga aga tgg agg cgt gNH2 | all 2'Ome bases,3' Amine | 1133 |
| arrestor | g aat cag tga aga tgg agg cg | all 2'Ome bases | 1134 |
| SRT | cggaagaagcagttggaggcgtgacggcNH2 | 3'2 bases 2'Ome, 3'Amine | 1135 |
| FRET probe | Fcaac(Cy3)gcttcctccg | | 1136 |
| probe | ccg tca cgc cct tgg ctc aat ttt gct NH2 | 3' Amine | 1137 |
| invader | cca ttc aat tcc tga aat taa agt tcg gat att ctc ttg gca | | 1138 |
| invader | cc tga aat taa agt tcg gat att ctc ttg gca | 5' 10 bases are 2'Ome | 1139 |
| invader | cc tga aat taa agt tcg gat att ctc ttg gca | | 1140 |
| arrestor | agc aaa att gag cca agg gcg NH2 | all 2'Ome bases,3' Amine | 1141 |
| arrestor | agc aaa att gag cca agg gcg tgNH2 | all 2'Ome bases,3' Amine | 1142 |
| SRT | cggagaagcagttggaggcgtgacggcNH2 | 3'2 bases 2'Ome, 3'Amine | 1143 |
| FRET probe | Fcaac(Cy3)gcttcctccg | | 1144 |
| probe | ccg tca cgc ctc cat ctt cac tga ttc ttg NH2 | 3' Amine | 1145 |
| invader | ttc tag caa acc cat tca att cct gaa att aaa gtt cgg ata ttc ta | | 1146 |
| invader | cc cat tca att cct gaa att aaa gtt cgg ata ttc ta | 5' 10 bases 2'Ome | 1147 |
| invader | cc cat tca att cct gaa att aaa gtt cgg ata ttc ta | | 1148 |
| arrestor | cca agg gcc aag gag gcg tNH2 | | 1149 |
| SRT | cggagaagcagttggaggcgtgacggcNH2 | 3'2 bases 2'Ome, 3'Amine | 1150 |
| FRET probe | Fcaac(Cy3)gcttcctccg | | 1151 |

FIG. 47A-16

| | | | |
|---|---|---|---|
| probe | ccg tca cgc ctc cat ctt cac tga ttc NH2 | 3' Amine | 1152 |
| invader | agt gtt gaa gta gat ttg ctt gaa gtt tca ctg ga | | 1153 |
| stacker | ttg gat acc aca gaa aat gaa tt | all 2'Ome bases | 1154 |
| SRT | cggaagaagcagttggaggcgtgacggtNH2 | 3'base 2'Ome, 3'Amine | 1155 |
| FRET probe | Fcaac(Cy3)gcttcctccg | | 1156 |
| probe | ccg tca cgc ctc cat ctt cac tga tt NH2 | 3' Amine | 1157 |
| invader | agt gtt gaa gta gat ttg ctt gaa gtt tca ctg ga | | 1158 |
| stacker | ctt gga tac cac aga gaa tga att | | 1159 |
| SRT | cggaagaagcagttggaggcgtgacggtNH2 | 3'base 2'Ome, 3'Amine | 1160 |
| FRET probe | Fcaac(Cy3)gcttcctccg | | 1161 |
| probe | ccg tca cgc ctc cat ctt cac tga ttc ttg NH2 | 3' Amine | 1162 |
| invader | agt gtt gaa gta gat ttg ctt gaa gtt tca ctg ga | | 1163 |
| helper | ata-cca-cag-aga-atg-aat-ttt-atg | all 2'Ome bases | 1164 |
| arrestor | tcc aag aat cag tga aga tgg agg cgt gNH2 | all 2'Ome bases, 3' Amine | 1165 |
| SRT | cggaagaagcagttggaggcgtgacggtNH2 | 3'base 2'Ome, 3'Amine | 1166 |
| FRET probe | Fcaac(Cy3)gcttcctccg | | 1167 |
| SRT | cggaagaagcagttggtgatctggcggNH2 | 3' Amine | 1168 |
| FRET probe | Fcaac(Cy3)gcttcctccg | | 1169 |
| SRT | cggaagaagcagttggaggcgtgacggtNH2 | 3'base 2'Ome, 3'Amine | 1170 |
| FRET probe | Fcaac(Cy3)gcttcctccg | | 1171 |
| SRT | ccaggaagaagcagttggaggcgtgacggu | 3' 3bases 2'Ome | 1172 |
| FRET probe | Fcaac(Z21)tgcttcgtgg | | 1173 |
| SRT | cggaagaagcagttggtgatctggcggNH2 | 3' 2 last base 2' Ome, 3' Amine | 1174 |
| FRET probe | Fcaac(Cy3)gcttcctccg | | 1175 |
| SRT | cggaagaagcagttggaggcgtgacggcNH2 | 3'2 bases 2'Ome, 3'Amine | 1176 |
| FRET probe | Fcaac(Cy3)gcttcctccg | | 1177 |
| SRT | ccaggaagcaagtgtcgcctcgttt | 3' last 3 bases 2'Ome | 1178 |
| FRET probe | Fcaac(Z21)tgcttcgtgg | | 1179 |

FIG. 47A-17

| Name | Sequence | Notes | SEQ ID |
|---|---|---|---|
| SRT | cggaggaagcagttggtgcctcgttaaNH2 | | 1180 |
| FRET probe | Fcaac(Cy3)gcttcctccg | 3' last5 bases 2'Ome | 1181 |
| SRT | cggaggaagcggttgtgatctcggcggcaNH2 | | 1182 |
| FRET probe | Fcaac(Cy3)gcttcctccg | 3' Last 2bases 2'Ome, 3' Amine | 1183 |
| SRT | gctactgagatgaaggagacgtgactgtaNH2 | | 1184 |
| FRET probe | Fcttc(Cy3)tctcagtagc | 3' Amine | 1185 |
| SRT | ccaggaagcagttggaggcgtgacggtNH2 | | 1186 |
| FRET probe | Fcaac(Cy3)gcttcgtgg | 3' 2 bases 2'Ome, 3'Amine | 1187 |
| h3A4 probe | agg agc cac tcc att gga tga agc | | 1188 |
| h3A4 invader | atg tac aga atc ccc ggt tat tta tgc aga | | 1189 |
| Capture Sequence | | | |
| Set 1 | | | |
| h3A4 probe | gtg gcg tat cac aga caa tga gag | | 1190 |
| h3A4 invader | cct cct tta tat tcc caa gta taa cac tct aa | | 1191 |
| Set 2/Set 3 | | | |
| h3A4 probe | AAC GAG GCG CAC CAC AGA CAA TGA GAG | | 1192 |
| h3A4 arrestor | CTCTCATTGTCTGTGGTGCG-NH2 | | 1193 |
| h3A4 invader | cct cct tta tat tcc caa gta taa cac tct aa | | 1194 |
| h3A4 stacking oligo | agctcaatgcatgtacagaatcccgg | | 1195 |
| h3A4 stacking oligo | agctcaatgcatgtacagaatcccgg | | 1196 |
| SRT | | | |
| FRET Oligo | | | |
| Set 4 | | | |
| h3A4 probe | aac gag gcg cac cac aga caa tga gag ag-NH2 | | 1197 |
| h3A4 arrestor | ctc tct cat tgt ctg tgg tgc g-NH2 | | 1198 |
| h3A4 invader | cct cct tta tcc caa gta taa cac tct aa | | 1199 |
| h3A4 stacking oligo | ctc aat gca tgt aca gaa tcc ccg gtt | | 1200 |

FIG. 47A-18

| | | |
|---|---|---|
| SRT | | |
| FRET Oligo | | |
| Set 5 | | |
| h3A4 probe | aac gag gcg cac cac aga caa tga gag agc t-NH2 | 1201 |
| h3A4 arrestor | agc tct ctc att gtc tgt ggt gcg-NH2 | 1202 |
| h3A4 invader | cct cct tta tat tcc caa gta taa cac tct aa | 1203 |
| SRT | | |
| FRET probe | FL-caa-c(cy3)g-ctt-cct-ccg | 1204 |
| Set 6 | | |
| h3A4 probe | aac gag gcg cac cac aga caa tga gag agc-NH2 | 1205 |
| h3A4 arrestor | gct ctc tca ttg tct gtg gtg cg-NH2 | 1206 |
| h3A4 invader | cct cct tta tat tcc caa gta taa cac tct aa | 1207 |
| SRT | | |
| FRET probe | FL-caa-c(cy3)g-ctt-cct-ccg | 1208 |
| Set 7/Set 8 | | |
| h3A4 probe | aac gag gcg cac cac aga caa tga gag a-NH2 | 1209 |
| h3A4 probe | aac gag gcg cac cac aga caa tga gag a | 1210 |
| h3A4 arrestor | tct ctc att gtc tgt ggt gcg c-NH2 | 1211 |
| h3A4 stacking oligo | gct caa tgc atg tac aga atc ccc ggt t | 1212 |
| h3A4 invader | cct cct tta tat tcc caa gta taa cac tct aa | 1213 |
| SRT | | |
| FRET Oligo | | |
| Set 9 | | |
| h3A4 probe | aac gag gcg cac cac aga caa tga ga-NH2 | 1214 |
| h3A4 arrestor | tct cat tgt ctg tgg tgc gc-NH2 | 1215 |
| h3A4 invader | cct cct tta tat tcc caa gta taa cac tct aa | 1216 |
| h3A4 stacking oligo | gag ctc aat gca tgt aca gaa tcc ccg | 1217 |
| SRT | | |
| FRET Oligo | | |

FIG. 47A-19

Set 1/Set 2
h3A4 probe         AACGAGGCGCACCTCTTATCAGAGCTC                                    1218
h3A4 probe         AACGAGGCGCACCTCTTATCAGAGCTC-NH2                                1219
h3A4 invader       ttg tgg agg aaa tta ttg aga aat gtt gat ta                     1220
h3A4 arrestor
SRT                GAGCTCTGATAAGAGGTGCG-NH2                                       1221

Set 1/ Set 2/ Set 3
h3A4 probe             ccg tca cgc ctc gcc cca ca - NH2                           1222
h3A4 arrestor          tgt ggg gcg agg cg                                         1223
h3A4 invader           cag cac agg ctg ttg acc atc ata aaa c                      1224
h3A4 stacking oligo    cuu-uuc-cau-acu-uuu-uau-gac-auu-c                          1225
h3A4 stacking oligo    ctt ttc cag act ttt tat gac att c                          1226
h3A4 stacking oligo    ctt ttc cag act ttt tat gac                                1227
SRT
FRET Set 4/Set 5
h3A4 probe             ccg tca cgc ctc gcc cca ca                                 1228
h3A4 probe             ccg tca cgc ctc gcc cca ca - HEX                           1229
h3A4 invader           cag cac agg ctg ttg acc atc ata aaa c                      1230
h3A4 stacking oligo    cuu-uuc-cau-acu-uuu-uau-gac-auu-c                          1231
SRT
FRET Set 6/ Set 7/ Set 8
h3A4 probe             ccg tca cgc ctc gcc cca cc - NH2                           1232
h3A4 probe             ccg tca cgc ctc gcc cca cg - NH2                           1233
h3A4 probe             ccg tca cgc ctc gcc cca ct - NH2                           1234
h3A4 arrestor          tgt ggg gcg agg cg                                         1235
h3A4 invader           cag cac agg ctg ttg acc atc ata aaa c                      1236
h3A4 stacking oligo    cuu-uuc-cau-acu-uuu-uau-gac-auu-c                          1237
SRT
FRET Set 1

FIG. 47A-20

| | | |
|---|---|---|
| h3A4 probe | ccg tca cgc ctg atc ata aaa gcc c -NH2 | 1238 |
| h3A4 arrestor | ggg ctt tta tga tca ggc g | 1239 |
| h3A4 invader | cag cac agg ctg ttg acc c | 1240 |
| h3A4 stacking oligo | cac act ttt cca tac ttt tta tg | 1241 |
| SRT | | |
| FRET | | |
| | | |
| Set 2 | | |
| h3A4 probe | aac gag gcg cac cca ttg gat gaa g - NH2 | 1242 |
| h3A4 arrestor | ctt cat cca atg ggt gcg c | 1243 |
| h3A4 invader | gta cag aat ccc cgg tta ttt atg cag ta | 1244 |
| h3A4 stacking oligo | ccc atc ttc att tca gag | 1245 |
| SRT | | |
| FRET | | |
| | | |
| Set 1 | | |
| h3A5 probe | gtg gcg tat cgt gtc taa ttt caa g | 1246 |
| h3A5 invader | aat ggg ttt ttc tgg ttg aag aag tcc ttg a | 1247 |
| Capture Sequence | | |
| | | |
| Set 2/Set 3 | | |
| h3A5 probe | AACGAGGCGCACCGTGTCTAATTTCAAG | 1248 |
| h3A5 probe | AACGAGGCGCACCGTGTCTAATTTCAAGGG-Pi | 1249 |
| h3A5 arrestor | CTTGAAATTAGACACGGTGCG-NH2 | 1250 |
| h3A5 invader | aat ggg ttt ttc tgg ttg aag aag tcc ttg a | 1251 |
| SRT | | |
| FRET | | |
| | | |
| Set 4 | | |
| h3A5 probe | AACGAGGCGCACCGTGTCTAATTTCAAG | 1252 |
| h3A5 arrestor | CTTGAAATTAGACACGGTGCG-NH2 | 1253 |
| h3A5 invader | aat ggg ttt ttc tgg ttg aag aag tcc ttg a | 1254 |
| h3A5 stacking oligo | ggg atc tgt gtt tct tta caa ggt | 1255 |
| SRT | | |
| FRET | | |
| | | |
| Set 5 | | |

FIG. 47A-21

| | | |
|---|---|---|
| h3A5 probe | AACGAGGCGCACCGTGTCTAATTTCAAG | 1256 |
| h3A5 arrestor | ctt gaa att aga cac ggt tct c | 1257 |
| h3A5 invader | ggt ttt tct ggt tga aga agt cct tga | 1258 |
| h3A5 stacking oligo | ggg atc tct gtt tct | 1259 |
| SRT | | |
| FRET | | |
| Set 6 | | |
| h3A5 probe | AACGAGGCGCACCGTGTCTAATTTCAAGGG-NH2 | 1260 |
| h3A5 arrestor | CCCTTGAAATTAGACACGGTGCG-NH2 | 1261 |
| h3A5 invader | aat ggg ttt ttc tgg ttg aag aag tcc ttg a | 1262 |
| h3A5 stacking oligo | | |
| SRT | | |
| FRET probe | FL-caa-c(cy3)g-ctt-cct-ccg | 1263 |
| Set 7/Set 8 | | |
| h3A5 probe | aac gag gcg cac cgt gtc taa ttt caa gg-NH2 | 1264 |
| h3A5 probe | aac gag gcg cac cgt gtc taa ttt caa gg | 1265 |
| h3A5 arrestor | cct tga aat tag aca cgg tgc gc-NH2 | 1266 |
| h3A5 arrestor | cct tga aat tag aca cgg tgc gc | 1267 |
| h3A5 invader | aat ggg ttt ttc tgg ttg aag aag tcc ttg a | 1268 |
| h3A5 stacking oligo | gga tct gtg ttt ctt tac aag gtt tga agg ag | 1269 |
| SRT | | |
| FRET | | |
| Set 9 | | |
| h3A5 probe | aac gag gcg cac cgt gtc taa ttt caa-NH2 | 1270 |
| h3A5 arrestor | ttg aaa tta gac acg gtg cgc-NH2 | 1271 |
| h3A5 invader | aat ggg ttt ttc tgg ttg aag aag tcc ttg a | 1272 |
| h3A5 stacking oligo | ggg gat ctg tgt ttc ttt aca agg | 1273 |
| SRT | | |
| FRET | | |
| Set 10 | | |
| h3A5 probe | aac gag gcg cac cgt gtc taa ttt ca - NH2 | 1274 |
| h3A5 arrestor | tga aat tag aca cgg tgc gc | 1275 |
| h3A5 invader | ggt ttt tct ggt tga aga agt cct tga | 1276 |
| h3A5 stacking oligo | agg gga tct gtg ttt ct | 1277 |

FIG. 47A-22

SRT
FRET

Set 1
h3A5 probe          tgg cgt atc tga ccc ttt ggg aat                                    1278
h3A5 invader        gaa gag cat aag ttg gaa tca cca cca ta                             1279
Capture Sequence Set 1
h3A5 probe          ata cgg ttg gtc ctc tca agt cta                                    1280
h3A5 invader        ccc cat tga ttt caa cat ctt tct tgc aac                            1281
Capture Sequence Set 2/Set 3
h3A5 probe          aac gag gcg cac gcg tgt cta att tc - NH2                           1282
h3A5 arrestor       gaa att aga cac gcg tgc gc                                         1283
h3A5 invader        ggt ttt tct ggt tga aga agt cct tc                                 1284
h3A5 stacking oligo ccg ggg atc tgt gtt tc                                             1285
SRT
FRET h3A5 probe          ccg tca cgc ctc gcg tgt cta att tc -NH2                            1286
h3A5 arrestor       gaa att aga cac gcg agg cg                                         1287
h3A5 invader        ggt ttt tct ggt tga aga agt cct tc                                 1288
h3A5 stacking oligo ccg ggg atc tgt gtt tc                                             1289
SRT
FRET Set 1
h3A5 probe          aac gag gcg cag ttc ata cgt tcc -NH2                               1290
h3A5 arrestor       gga acg tat gaa ctg cgc                                            1291
h3A5 invader        cca gca cag gga gtt gac ca                                         1292
h3A5 stacking oligo cca cat ttt tcc ata ctt t                                          1293
SRT
FRET Set 2

FIG. 47A-23

| | | |
|---|---|---|
| h3A5 probe | ccg tca cgc ctg ttc ata cgt tcc -NH2 | 1294 |
| h3A5 arrestor | gga acg tat gaa cag gcg | 1295 |
| h3A5 invader | cca gca cag gga gtt gac ca | 1296 |
| h3A5 stacking oligo | cca cat ttt tcc ata ctt t | 1297 |
| SRT | | |
| FRET | | |
| Set 1-Set 4 | | |
| h3A5 probe | aac gag gcg cac agt tga cct tca | 1298 |
| h3A5 probe | aac gag gcg cac agt tga cct tca | 1299 |
| h3A5 probe | aac gag gcg cac agt tga cct tca - HEX | 1300 |
| h3A5 arrestor | tga agg tca act gtg cgc | 1301 |
| h3A5 invader | gtg atg gcc agc aca ggg c | 1302 |
| h3A5 stacking oligo | tac gtt ccc cac att ttt c | 1303 |
| h3A5 stacking oligo | tac gtt ccc cac att ttt c | 1304 |
| SRT | | |
| FRET | | |
| Set 5 | | |
| h3A5 probe | ccg tca cgc ctc agt tga cct tca | 1305 |
| h3A5 arrestor | tga agg tca act gag gcg | 1306 |
| h3A5 invader | gtg atg gcc agc aca ggg c | 1307 |
| h3A5 stacking oligo | tac gtt ccc cac att ttt c | 1308 |
| SRT | | |
| FRET | | |
| Set 6 | | |
| h3A5 probe | aac gag gcg cac tcc tct caa gt -NH2 | 1309 |
| h3A5 arrestor | act tga gag gag tgc gc | 1310 |
| h3A5 invader | cca ttg att tca aca tct ttc ttg caa ga | 1311 |
| h3A5 stacking oligo | cta ata gca act ggg aat aat c | 1312 |
| SRT | | |
| FRET | | |
| Set 7 | | |
| h3A5 probe | ccg tca cgc ctc tcc tct caa gt - NH2 | 1313 |
| h3A5 arrestor | act tga gag gag agg cg | 1314 |

FIG. 47A-24

| | | |
|---|---|---|
| h3A5 invader | cca ttg att tca aca tct ttc ttg caa ga | 1315 |
| h3A5 stacking oligo | <u>cta ata gca act ggg aat aat c</u> | 1316 |
| SRT | | |
| FRET | | |
| | | |
| Set 8 | | |
| h3A5 probe | aac gag gcg cac agt tga cct tc - NH2 | 1317 |
| h3A5 arrestor | <u>tga agg tca act gtg cgc</u> | 1318 |
| h3A5 invader | gtg atg gcc agc aca ggg c | 1319 |
| h3A5 stacking oligo | <u>ata cgt tcc cca cat ttt tc</u> | 1320 |
| SRT | | |
| FRET | | |
| | | |
| Set 1 | | |
| h3A7 Probe | tgg cgt atc tgg att aaa tct taa aag | 1321 |
| h3A7 Invader Capture Oliog | gac ttt tat tga gag aac gaa tgg atc taa a | 1322 |
| | | |
| Set 2 | | |
| h3A7 Primary Probe | AACGAGGCGCACTGGATTAAATCTTAAAAG | 1323 |
| h3A7 Invader | gac ttt tat tga gag aac gaa tgg atc taa a | 1324 |
| h3A7 Arrestor | <u>CTTTTAAGATTAATCCAGTGCG</u>-NH2 | 1325 |
| SRT | | |
| FRET | | |
| | | |
| Set 3 | | |
| h3A7 Primary Probe | AACGAGGCGCACTGGATTAAATCTTAAAAG | 1326 |
| h3A7 Invader | gac ttt tat tga gag aac gaa tgg atc taa a | 1327 |
| h3A7 Arrestor | <u>CTTTTAAGATTAATCCAGTGCG</u>-NH2 | 1328 |
| h3A7 Stacking Oligo | <u>ctt ctt ggt gtt ttc ca</u> | 1329 |
| SRT | | |
| FRET | | |
| | | |
| Set 4 | | |
| h3A7 Probe | agg agc cac tca tcc ctt gac t | 1330 |
| h3A7 Invader oligo Capture Oligo | ctt agg gaa atc agg ctc cac tta cgg ta | 1331 |

FIG. 47A-25

| | | |
|---|---|---|
| Set 5/Set 6 | | |
| h3A7 Primary Probe | AACGAGGCGCACCTCATCCCTTGACT | 1332 |
| h3A7 Primary Probe | AACGAGGCGCACCTCATCCCTTGACT-NH2 | 1333 |
| h3A7 Arrestor | AGTCAAGGGATGAGGTGCG-NH2 | 1334 |
| h3A7 Invader oligo | ctt agg gaa atc agg ctc cac tta cgg ta | 1335 |
| SRT | | |
| FRET | | |
| | | |
| Set 7 - Set 10 | | |
| h3A7 Primary Probe | aac gag gcg cac ctc atc cct tga c-NH2 | 1336 |
| h3A7 Arrestor | gtc aag gga tga ggt gcg c-NH2 | 1337 |
| h3A7 Invader oligo | ctt agg gaa atc agg ctc cac tta cgg ta | 1338 |
| h3A7 Stacking Oligo | tca gcc ttt aga aca atg ggt ttt tct gtt ag3' | 1339 |
| h3A7 Stacking Oligo | tca gcc ttt aga aca atg ggt ttt tct g | 1340 |
| h3A7 Stacking Oligo | ctc agc ctt tag aac aat ggg ttt ttc t | 1341 |
| h3A7 Stacking Oligo | ctc agc ctt tag aac aat ggg ttt ttc t | 1342 |
| SRT | | |
| FRET | | |
| | | |
| Set 11 | | |
| h3A7 Primary Probe | aac gag gcg cac ctc atc cct tga-NH2 | 1343 |
| h3A7 Primary Probe | aac gag gcg cac ctc atc cct tga c | 1344 |
| h3A7 Arrestor | tca agg gat gag gtg cgc-NH2 | 1345 |
| h3A7 Invader oligo | ctt agg gaa atc agg ctc cac tta cgg ta | 1346 |
| h3A7 Stacking Oligo | ctc agc ctt tag aac aat ggg ttt ttc tgt tag | 1347 |
| SRT | | |
| FRET | | |
| | | |
| Set 1 | | |
| h3A7 Probe | ata cgg ttg gta aag taa ttt gag gt | 1348 |
| h3A7 Invader | gaa gcc cgt ctt cat ttc agg gtt cta ttt c | 1349 |
| Capture Sequence | | |

FIG. 47A-26

| | | |
|---|---|---|
| Set 2 | | |
| h3A7 Primary Probe | AACGAGGCGCACGTAAAGTAATTTGAGGT | 1350 |
| h3A7 Invader | gaa gcc cgt ctt cat ttc agg gtt cta ttt c | 1351 |
| h3A7 Arrestor | ACCTCAAATTACTTTACGTGCG-NH2 | 1352 |
| SRT | | |
| FRET | | |
| Set 3 | | |
| h3A7 Primary Probe | AACGAGGCGCACGTAAAGTAATTTGAGGT | 1353 |
| h3A7 Invader | gaa gcc cgt ctt cat ttc agg gtt cta ttt c | 1354 |
| h3A7 Arrestor | ACCTCAAATTACTTTACGTGCG-NH2 | 1355 |
| h3A7 Stacking Oligo | ctc tgg tgt tct ggg | 1356 |
| SRT | | |
| FRET | | |
| Set 1 | | |
| h3A7 probe | ccg tca cgc ctc gtc ata aat acc cc - NH2 | 1357 |
| h3A7 arrestor | ggg gtc ttt atg acg agg cg | 1358 |
| h3A7 invader | gcc agc ata ggc tgt tga cac | 1359 |
| h3A7 stacking oligo | aga ctt ttc tat act ttt tat aac att c | 1360 |
| FRET | | |
| Set 2 - Set 4 | | |
| h3A7 probe | aac gag gcg cac gtc ata aat acc cc -NH2 | 1361 |
| h3A7 probe | aac gag gcg cac gtc ata aat acc cc | 1362 |
| h3A7 probe | aac gag gcg cac gtc ata aat acc cc - HEX | 1363 |
| h3A7 arrestor | ggg gta ttt atg acg tgc gc | 1364 |
| h3A7 invader | gcc agc ata ggc tgt tga cac | 1365 |
| h3A7 stacking oligo | aga ctt ttc tat act ttt tat aac att c | 1366 |
| SRT | | |
| FRET | | |
| Set 1 | | |
| h3A7 probe | ccg tca cgc ctc gat taa atc tta aaa gct t - NH2 | 1367 |
| h3A7 arrestor | aag ctt tta aga ttt aat cga ggc g | 1368 |
| h3A7 invader | gac ttt tat tga gag aac gaa tgg atc taa tgc | 1369 |

FIG. 47A-27

| | | |
|---|---|---|
| h3A7 stacking oligo | ctt ggt gtt ttc cac aaa g | 1370 |
| SRT | | |
| FRET | | |
| | | |
| Set 2 | | |
| h3A7 probe | aac gag gcg cac gat taa atc tta aaa gct t -NH2 | 1371 |
| h3A7 arrestor | aag ctt tta aga ttt aat cgt gcg c | 1372 |
| h3A7 invader | gac ttt tat tga gag aac gaa tgg atc taa tgc | 1373 |
| h3A7 stacking oligo | ctt ggt gtt ttc cac aaa g | 1374 |
| SRT | | |
| FRET | | |
| | | |
| Set 1 | | |
| h3A7 probe | ccg tca cgc ctg tca tcc ctt g - NH2 | 1375 |
| h3A7 arrestor | caa ggg atg cac ggc g | 1376 |
| h3A7 invader | gga aat cag gct cca ctt acg gtc a | 1377 |
| h3A7 stacking oligo | act cag cct tta gaa caa tg | 1378 |
| SRT | | |
| FRET | | |
| | | |
| Set 1 | | |
| h3A7 probe | ccg tca cgc ctc taa agt aat ttg agg tc -NH2 | 1379 |
| h3A7 arrestor | gac ctc aaa tta ctt tag agg cg | 1380 |
| h3A7 invader | cgt ctt cat ttc agg gtt cta ttt ga | 1381 |
| h3A7 stacking oligo | tct ggt gtt ctg gg | 1382 |
| SRT | | |
| FRET | | |
| | | |
| Set 2 | | |
| h3A7 probe | aac gag gcg cac taa agt aat ttg agg tc - NH2 | 1383 |
| h3A7 arrestor | gac ctc aaa gga ctt tag tgc gc | 1384 |
| h3A7 invader | cgt ctt cat ttc agg gtt cta ttt ga | 1385 |
| h3A7 stacking oligo | tct ggt gtt ctg gg | 1386 |
| SRT | | |
| FRET | | |

FIG. 47A-28

Set 1
r4A1 Probe  tgg-cgt-atc-tag-gct-ttg-ctt-cc  1387
r4A1 Invader  ttc atg tag tca ggg tca tag aca att aag a  1388
Capture Sequence Set 2
r4A1 Primary Probe  AACGAGGCGCACTAGGCTTTGCTTCC  1389
r4A1 Arrestor  GGAAGCAAAGCCTAGTGCG-NH2  1390
r4A1 Arrestor  gga agc gaa gcc tag tgc gc-NH2  1391
r4A1 Invader  ttc atg tag tca ggg tca tag aca att aag a  1392
FRET Probe 1

Set 3
r4A1 Primary Probe  aac gag gcg cac tag gct ttg ctt ccc-NH2  1393
r4A1 Arrestor  ggg aag caa agc cta gtg cgc-NH2  1394
r4A1 Invader  ttc atg tag tca ggg tca tag aca att aag a  1395
SRT
FRET Probe 1

Set 4
r4A1 Primary Probe  aac gag gcg cac tag gct ttg ctt c-NH2  1396
r4A1 Arrestor  gaa gca aag cct agt gcg c  1397
r4A1 Stacker  ccc aga acc atc gag gaa agg c  1398
r4A1 Invader  ttc atg tag tca ggg tca tag aca att aag a  1399
SRT
FRET Probe 1

Set 5
r4A1 Primary Probe  aac gag gcg cac tag gct ttg ctt-NH2  1400
r4A1 Arrestor  aag caa agc cta gtg cgc-NH2  1401
r4A1 Invader  ttc atg tag tca ggg tca tag aca att aag a  1402
r4A1 Stacker  ccc cag aac cat cga gga aag g  1403
r4A1 Stacker  ccc cag aac cat cga gga aag g  1404
SRT
FRET Probe 1

Set 6

FIG. 47A-29

| | | |
|---|---|---|
| r4A1 Primary Probe | aac gag gcg cac tag gct ttg ct-NH2 | 1405 |
| r4A1 Primary Probe | aac gag gcg cac tag gct ttg ct - HEX | 1406 |
| r4A1 Probe | aac gag gcg cac tag gct ttg ct | 1407 |
| r4A1 Arrestor | <u>agc aaa gcc tag tgc gc</u>-NH2 | 1408 |
| r4A1 Arrestor | <u>agc aaa gcc tag tgc gc</u> | 1409 |
| r4A1 Invader | ttc atg tag tca ggg tca tag aca att aag a | 1410 |
| r4A1 Stacker | tcc cca gaa cca tcg agg aaa gg | 1411 |
| r4A1 Stacker | <u>tcc cca gaa cca tcg agg aaa gg</u> | 1412 |
| SRT | | |
| FRET Probe 1 | | |

| Set 1 | | |
|---|---|---|
| r4A1 Probe | ata cgg ttg gtc ttg acc tgc c | 1413 |
| r4A1 Invader | agg aga tat gtt gaa aga ttt cta tag agg ac | 1414 |
| Capture Sequence | | |

| Set 2 | | |
|---|---|---|
| r4A1 Primary Probe | AACGAGGCGCACGTCTTGACCTGCC | 1415 |
| r4A1 Arrestor | <u>GGCAGGTCAAGACGTGCG</u>-NH2 | 1416 |
| r4A1 Invader | agg aga tat gtt gaa aga ttt cta tag agg ac | 1417 |
| SRT | | |
| FRET Probe 1 | | |

| Set 3 | | |
|---|---|---|
| r4A1 Primary Probe | AACGAGGCGCACGTCTTGACCTGC-Pi | 1418 |
| r4A1 Arrestor | <u>GGCAGGTCAAGACGTGCG</u>-NH2 | 1419 |
| r4A1 Invader | agg aga tat gtt gaa aga ttt cta tag agg ac | 1420 |
| SRT | | |
| FRET Probe 1 | | |

| Set 1 | | |
|---|---|---|
| r4A1 Probe | tgg cgt atc tta gat gga gta agg a | 1421 |
| r4A1 Invader | att cct cat aat tca aaa ggg act tag tag gt | 1422 |

FIG. 47A-30

| | | |
|---|---|---|
| Set 2 | | |
| r4A1 Primary Probe | AACGAGGCGCACTTAGATGGAGTAAGGA | 1423 |
| r4A1 Arrestor | TCCTTACTCGATCTAAGTGCG-NH2 | 1424 |
| SRT | | |
| FRET Probe 1 | | |
| | | |
| Set 1 | | |
| r4A1 Primary Probe | aac gag gcg cac tgg ata ccc ttg gg-NH2 | 1425 |
| r4A1 Arrestor | ccc aag ggt atc cag tgc gc-NH2 | 1426 |
| r4A1 Invader | ggt gga gac cat aaa tgg aga gtg tga cta | 1427 |
| SRT | | |
| FRET Probe 1 | | |
| | | |
| Set 1 | | |
| r4A2 Probe | aac gag gcg cac agg tgt ctg gag taa aag-NH2 | 1428 |
| r4A2 Arrestor | ctt tta ctc cag aca cct gtg cgc-NH2 | 1429 |
| r4A2 Invader | gtc cac gca caa gct ggg ac | 1430 |
| SRT | | |
| FRET Probe 1 | | |
| | | |
| Set 1 | | |
| r4A2 Probe | aac gag gcg cac aga agg ccc ctt-NH2 | 1431 |
| r4A2 Arrestor | aag ggg cct tct gtg cgc-NH2 | 1432 |
| r4A2 Invader | cct tga aca gca cca gaa ata gac tga gca c | 1433 |
| r4A2 stacking oligo | gga aga acc cag aga cac cat cc | 1434 |
| SRT | | |
| FRET Probe 1 | | |
| | | |
| Set 2 | | |
| r4A2 Probe | ccg tca cgc ctc aga agg ccc ctt-NH2 | 1435 |
| r4A2 Arrestor | aag ggg cct tct gag gcg-NH2 | 1436 |
| r4A2 Invader | cct tga aca gca cca gaa ata gac tga gca c | 1437 |
| SRT | | |
| FRET Probe 1 | | |
| | | |
| Set 3 | | |
| r4A2 Probe | aac gag gcg cac aga agg ccc ctt g-NH2 | 1438 |

FIG. 47A-31

| Name | Sequence | SEQ ID |
|---|---|---|
| r4A2 Arrestor | caa gag gcc ttc tgt gcg c-NH2 | 1439 |
| r4A2 Invader | cct tga aca gca cca gaa ata gac tga gca c | 1440 |
| SRT | | |
| FRET Probe 1 | | |
| Set 4 | | |
| r4A2 Probe | aac gag gcg cac aga agg ccc ctt gg-NH2 | 1441 |
| r4A2 Probe | aac gag gcg cac aga agg ccc ctt | 1442 |
| r4A2 Probe | aac gag gcg cac aga agg ccc ctt - HEX | 1443 |
| r4A2 Arrestor | cca agg ggc ctt ctg tgc gc-NH2 | 1444 |
| r 4A2 Arrestor | aag ggg cct tct gtg cgc | 1445 |
| r4A2 Invader | cct tga aca gca cca gaa ata gac tga gca c | 1446 |
| SRT | | |
| FRET Probe 1 | | |
| Set 1 | | |
| r4A3 Probe | aac gag gcg cac ttg aca gag tcc gc-NH2 | 1447 |
| r4A3 Arrestor | gcg gac tct gtc aag tgc gc-NH2 | 1448 |
| r4A3 Invader | gct tct ccc att tgt cta gca tta taa | 1449 |
| SRT | | |
| FRET Probe 1 | | |
| Set 2 | | |
| r4A3 Probe | aac gag gcg cac ttg aca gag tcc g-NH2 | 1450 |
| r4A3 Arrestor | cgg act ctg tca agt gcg c-NH2 | 1451 |
| r4A3 Invader | gct tct ccc att tgt cta gca tta taa | 1452 |
| r4A3 stacking oligo | cca tga ttt tga cat agg gtt tga gga tg | 1453 |
| SRT | | |
| FRET Probe 1 | | |
| Set 3 | | |
| r4A3 Probe | aac gag gcg cac ttg aca gag tcc-NH2 | 1454 |
| r4A3 Probe | aac gag gcg cac ttg aca gag tcc | 1455 |
| rCYP 4A3 Probe | aac gag gcg cac ttg aca gag tcc - HEX | 1456 |
| r4A3 Arrestor | gga ctc tgt caa gtg cgc-NH2 | 1457 |
| rCYP 4A3 Arrestor | gga ctc tgt caa gtg cgc | 1458 |
| r4A3 Invader | gct tct ccc att tgt cta gca tta taa | 1459 |

FIG. 47A-32

| | | SEQ ID |
|---|---|---|
| r4A3 stacking oligo | gcc atg att ttg aca tag ggt ttg agg atg | 1460 |
| SRT | | |
| FRET Probe 1 | | |
| | | |
| Set 1 | | |
| r2B1 probe | cgg agc ctc tgc ggt cat caa g | 1461 |
| r2B1 invader | tgg ata act gca tca gtg tat ggc att tta a | 1462 |
| Capture Sequence | | |
| | | |
| Set 2/ Set 3 | | |
| r2B1 probe | gtg-gcg-tat-ctg-cgg-tca-tca-ag | 1463 |
| r2B1 probe | gtg-gcg-tat-ctg-cgg-tca-tca-a | 1464 |
| r2B1 invader | tgg ata act gca tca gtg tat ggc att tta a | 1465 |
| Capture Sequence | | |
| | | |
| Set 4 | | |
| r2B1 probe | tg-gcg-tat-ctg-cgg-tca-tca-a | 1466 |
| r2B1 invader | tgg ata act gca tca gtg tat ggc att tta a | 1467 |
| Capture Sequence | | |
| | | |
| Set 5 - Set 7 | | |
| r2B1 probe | aac-gag-gcg-cac-ctg-cgg-tca-tca-a | 1468 |
| r2B1 arrestor | ttg-atg-acc-gca-ggt-gcg-cc-NH2 | 1469 |
| r2B1 arrestor | ttg-atg-acc-gca-ggt-gcg-cc-Pi | 1470 |
| r2B1 arrestor | ttg-atg-acc-gca-ggt-gcg-cc-OH | 1471 |
| r2B1 invader | tgg ata act gca tca gtg tat ggc att tta a | 1472 |
| SRT | | |
| FRET | | |
| | | |
| Set 8 | | |
| r2B1 probe | aac-gag-gcg-cac-ctg-cgg-tca-tca-a | 1473 |
| r2B1 arrestor | ttg-atg-acc-gca-ggt-gcg-cc-Pi | 1474 |
| r2B1 invader | tgg ata act gca tca gtg tat ggc att tta a | 1475 |
| r2B1 stacker | ggg ttg gta gcc tgt gtg agc cga t | 1476 |
| SRT | | |
| FRET | | |

FIG. 47A-33

```
Set 9
r2B1 probe       aac-gag-gcg-cac-ctg-cgg-tca-tca-a-NH2                          1477
r2B1 arrestor    ttg-atg-acc-gca-ggt-gcg-NH2                                    1478
r2B1 invader     tgg ata act gca tca gtg tat ggc att tta a                      1479
SRT
FRET Set 10
r2B1 probe       ggc-aac-gag-gca-cac-ctg-cgg-tca-tca-ag-Pi                      1480
r2B1 arrestor    ttg-atg-acc-gca-ggt-gcg-cc-Pi                                  1481
r2B1 invader     tgg ata act gca tca gtg tat ggc att tta a                      1482
SRT
FRET Set 11
r2B1 probe       aac gag ggg cac ctg cgg tca tca ag-NH2                         1483
r2B1 arrestor    ctt gat gac cgc agg tgc c-NH2                                  1484
r2B1 invader     tgg ata act gca tca gtg tat ggc att tta a                      1485
SRT
FRET Set 12
r2B1 probe       aac gag gcg cac ctg cgg tca tca agg-NH2                        1486
r2B1 arrestor    cct tga tga ccg cag gtg cg-NH2                                 1487
r2B1 invader     tgg ata act gca tca gtg tat ggc att tta a                      1488
SRT
FRET Set 13
r2B1 probe       atg acg tga cag acc tgc ggt cat caa g-NH2                      1489
r2B1 arrestor    ctt gat gac cgc agg tct gt-NH2                                 1490
r2B1 invader     tgg ata act gca tca gtg tat ggc att tta a                      1491
SRT
FRET
```

FIG. 47A-34

Set 14
r2B1 probe    aac gag gcg cac ctg agg tca tca a-NH2                                    1492
r2B1 arrestor ttg atg acc tca ggt gcg-NH2                                              1493
r2B1 invader  tgg ata act gca tca gtg tat ggc att tta a                                1494
SRT
FRET Set 15
r2B1 probe    cag tca cgt ctc ctg cgg tca tca ag-NH2                                   1495
r2B1 arrestor ctt gat gac cgc agg aga cg-NH2                                           1496
r2B1 invader  tgg ata act gca tca gtg tat ggc att tta a                                1497
SRT
FRET Set 16
r2B1 probe    cag tca cgt ctc act gcg gtc atc aag-NH2                                  1498
r2B1 invader  gtg gat aac tgc atc agt gta tgg cat ttt c                                1499
r2B1 arrestor ctt gat gac cgc agt gag acg-NH2                                          1500
SRT
FRET Set 17
r2B1 probe    cag tca cgt ctc act gcg gtc atc aa-NH2                                   1501
r2B1 arrestor ttg atg acc gca gtg aga cg-NH2                                           1502
r2B1 invader  gtg gat aac tgc atc agt gta tgg cat ttt c                                1503
r2B1 stacker  ggg ttg gta gcc tgt gtg agc cga t                                        1504
SRT
FRET Set 18
r2B1 probe    cag tca cgt ctc act gcg gtc atc a-NH2                                    1505
r2B1 arrestor tga tga ccg cag tga gac g-NH2                                            1506
r2B1 invader  gtg gat aac tgc atc agt gta tgg cat ttt c                                1507
r2B1 stacker  agg gtt ggt agc ctg tgt gag ccg a                                        1508
SRT
FRET

FIG. 47A-35

Set 19
r2B1 probe      cag tca cgt ctc act gcg gtc atc aag-NH2                1509
r2B1 arrestor   ctt gat gac cgc agt gag acg-NH2                         1510
r2B1 invader    gtg gat aac tgc atc agt gta tgg cat ttt c               1511
r2B1 stacker    ggt tgg tag cct gtg gcc gat c                           1512
SRT
FRET Set 20
r2B1 probe      cag tca cgt ctc act gcg gtc at-NH2                      1513
r2B1 arrestor   atg acc gca gtg aga cg-NH2                              1514
r2B1 invader    gtg gat aac tgc atc agt gta tgg cat ttt c               1515
r2B1 stacker    caa ggg ttg gta gcc tgt gtg agc c                       1516
SRT
FRET Set 21
r2B1 probe      ccg tca cgc ctc act gcg gtc atc a-NH2                   1517
r2B1 arrestor   tga tga ccg cag tga ggc g-NH2                           1518
r2B1 invader    gtg gat aac tgc atc agt gta tgg cat ttt c               1519
r2B1 stacker    agg gtt ggt agc ctg tgt gag ccg a                       1520
SRT
FRET Set 22
r2B1 probe      ccg tca cgc ctc act gcg gtc atc-NH2                     1521
r2B1 arrestor   gat gac cgc agt gag gcg-NH2                             1522
r2B1 invader    gtg gat aac tgc atc agt gta tgg cat ttt c               1523
r2B1 stacker    aag ggt tgg tag ccg gtg tg                              1524

Set 23
r2B1 probe      ccg tca cgc ctc act gcg gtc at-NH2                      1525
r2B1 probe      ccg tca cgc ctc act gcg gtc at                          1526
r2B1 arrestor   atg acc gca gtg agg cg-NH2                              1527
r2B1 invader    gtg gat aac tgc atc agt gta tgg cat ttt c               1528
r2B1 stacker    caa ggg ttg gta gcc tgt gtg agc c                       1529
SRT

FIG. 47A-36

| | | | |
|---|---|---|---|
| FRET | | | |
| Set 1 | | | |
| r2B1 invader | atg gtg tct ttg gtg act ctg tgt ggt aca | | 1530 |
| r2B1 probe | aac-gag-gcg-cac-tcc-aat-agg-gac-aag | | 1531 |
| r2B1 arrestor | ctt-gtc-cct-att-gga-gtg-cgc-c | | 1532 |
| SRT | | | |
| FRET | | | |
| Set 1 | | | |
| r2B1 probe | gcg gcg tac agc cgg tgt gag c | | 1533 |
| r2B1 invader | cat ttt act gcg gtc atc aag ggt tgg tc | | 1534 |
| Capture Sequence | | | |
| r2B1 probe | tgg cgt atg agc cgg tgt gag c | | 1535 |
| r2B1 invader | cat ttt act gcg gtc atc aag ggt tgg tc | | 1536 |
| Capture Sequence | | | |
| Set 1 | | | |
| r2B2 invader | gga tga ctg cat cag tgt atg gca ttt tgc | | 1537 |
| r2B2 probe | aac-gag-gcg-cac-gta-cga-tca-tca-agg | | 1538 |
| r2B2 arrestor | cct-tga-tga-tcg-tac-gtg-cgc-c-NH2 | | 1539 |
| SRT | | | |
| FRET | | | |
| Set 1 | | | |
| r2B2 invader | atg gtg tct ttg gtg act ctg tgt ggt aac | | 1540 |
| r2B2 probe | tgg cgt atg acc aat tgg ggc aa | | 1541 |
| r2B2 stacker | gat ctg caa atc tct gaa tct cgt gga tg | | 1542 |
| r2B2 invader stacker | tct tgg aga gca ggt acc ctc gga ac | | 1543 |
| Set 2 | | | |
| r2B2 probe | tgg cgt atg acc aat tgg ggc aag | | 1544 |
| r2B2 invader | atg gtg tct ttg gtg act ctg tgt ggt aac | | 1545 |
| r2B2 stacker | atc tgc aaa tct ctg aat ctc gtg gat ga | | 1546 |
| r2B2 invader stacker | tct tgg aga gca ggt acc ctc gga ac | | 1547 |

FIG. 47A-37

| | | |
|---|---|---|
| Set 3 | | |
| r2B2 probe | aac-gag-gcg-cac-acc-aat-tgg-ggc-aag | 1548 |
| r2B2 probe | aac gac gcg cac acc aat tgg ggc aag | 1549 |
| r2B2 arrestor | ctt-gcc-cca-att-ggt-gtg-cgc-c-NH2 | 1550 |
| r2B2 invader | atg gtg tct ttg gtg act ctg tgt ggt aac | 1551 |
| SRT | | |
| FRET | | |
| Set 4 | | |
| r2B2 probe | aac-gag-gcg-cac-acc-aat-tgg-ggc-aag-Pi | 1552 |
| r2B2 arrestor | ctt-gcc-cca-att-ggt-gtg-cgc-c-Pi | 1553 |
| r2B2 invader | atg gtg tct ttg gtg act ctg tgt ggt aac | 1554 |
| SRT | | |
| FRET | | |
| Set 5 | | |
| r2B2 arrestor | ctt gcc cca att ggt gtg cg-NH2 | 1555 |
| r2B2 probe | aac-gag-gcg-cac-acc-aat-tgg-ggc-aag-NH2 | 1556 |
| r2B2 invader | atg gtg tct ttg gtg act ctg tgt ggt aac | 1557 |
| r2B2 stacker | atc tgc aaa tct ctg aat ctc gtg gat ga | 1558 |
| SRT | | |
| FRET | | |
| Set 6 | | |
| r2B2 probe | ggc-aac-gag-gca-cac-caa-ttg-ggg-caa-g | 1559 |
| r2B2 arrestor | ctt-gcc-cca-att-ggt-gtg-cgc-c-NH2 | 1560 |
| r2B2 invader | atg gtg tct ttg gtg act ctg tgt ggt aac | 1561 |
| SRT | | |
| FRET | | |
| Set 7 | | |
| r2B2 probe | aac gag gcg cac acc aat tgg ggc aag atc-NH2 | 1562 |
| r2B2 arrestor | gat ctt gcc cca att ggt gtg cg-NH2 | 1563 |
| r2B2 invader | atg gtg tct ttg gtg act ctg tgt ggt aac | 1564 |
| SRT | | |
| FRET | | |

FIG. 47A-38

| | | SEQ ID NO |
|---|---|---|
| Set 8 | | |
| r2B2 probe | aac gag gcg cac acc aat tcg ggc aag-NH2 | 1565 |
| r2B2 arrestor | ctt gcc cga att ggt gtg cg-NH2 | 1566 |
| r2B2 invader | atg gtg tct ttg gtg act ctg tgt ggt aac | 1567 |
| r2B2 stacker | atc tgc aaa tct ctg aat ctc gtg gat ga | 1568 |
| SRT | | |
| FRET | | |
| Set 9 | | |
| r2B2 probe | cag tca cgt ctc atg gtg gcc tgt g-NH2 | 1569 |
| r2B2 invader | gta tgg cat ttt ggt acg atc atc aag ggc | 1570 |
| r2B2 arrestor | cac agg cca cca tga gac g-NH2 | 1571 |
| SRT | | |
| FRET | | |
| Set 10 | | |
| r2B2 probe | cag tca cgt ctc aga gcc aat cac ctg-NH2 | 1572 |
| r2B2 invader | cga tca tca agg gat ggt ggc ctg tgc | 1573 |
| r2B2 arrestor | cag gtg att ggc tct gag acg-NH2 | 1574 |
| r2B2 stacker | atc aat ctc ctt ttg gac ttt ctc tgc g | 1575 |
| SRT | | |
| FRET | | |
| Set 11 | | |
| r2B2 probe | cag tca cgt ctc aga gcc aat cac ct-NH2 | 1576 |
| r2B2 invader | cga tca tca agg gat ggt ggc ctg tgc | 1577 |
| r2B2 arrestor | agg tga ttg gct ctg aga cg-NH2 | 1578 |
| r2B2 stacker | gat caa tct cct ttt gga ctt tct ctg c | 1579 |
| SRT | | |
| FRET | | |
| Set 12 | | |
| r2B2 probe | FAM-cag tca cgt ctc aga gcc aat cac ct-NH2 | 1580 |

FIG. 47A-39

Set 13 / Set 14
r2B2 probe      cag tca cgt ctc aga gcc aat cac c-NH2        1581
r2B2 arrestor   ggt gat tgg ctc tga gac g-NH2                1582
r2B2 invader    cga tca tca agg gat ggt ggc ctg tgc          1583
r2B2 stacker    gat caa tct cct ttt gga ctt tct ctg c        1584
r2B2 stacker    tga tca atc tcc ttt tgg act ttc tct gc       1585
SRT
FRET Set 15
r2B2 probe      cag tca cgt ctc aga gcc aat cac-NH2          1586
r2B2 arrestor   gtg att ggc tct gag acg-NH2                  1587
r2B2 invader    ctg atc aat ctc ctt ttg gac ttt ctc tgc g    1588
r2B2 stacker    cga tca tca agg gat ggt ggc ctg tgc          1589
SRT
FRET Set 16
r2B2 probe      cag tca cgt ctc aga gcc aat cac ct-NH2       1590
r2B2 arrestor   agg tga ttg cct ctg aga cg-NH2               1591
r2B2 invader    cga tca tca agg gat ggt ggc ctg tgc          1592
r2B2 stacker    gat caa tct cct ttt gga ctt tct ctg c        1593
SRT
FRET Set 17
r2B2 probe      cag tca cgt ctc aga gcc aat cac ctg-NH2      1594
r2B2 arrestor   cag gtg att gcc tct gag acg-NH2              1595
r2B2 invader    cga tca tca agg gat ggt ggc ctg tgc          1596
r2B2 stacker    atc aat ctc ctt ttg gac ttt ctc tgc g        1597
SRT
FRET Set 18
r2B2 probe      ccg tca cgc ctc aga gcc aat cac ct-NH2       1598
r2B2 arrestor   agg tga ttg gct ctg agg cg-NH2               1599
r2B2 invader    cga tca tca agg gat ggt ggc ctg tgc          1600

FIG. 47A-40

| | | |
|---|---|---|
| r2B2 stacker | gat caa tct cct ttt gga ctt tct ctg c | 1601 |
| SRT | | |
| FRET | | |
| Set 19 | | |
| r2B2 probe | ccg tca cgc ctc aga gcc aat cac c-NH2 | 1602 |
| r2B2 arrestor | ggt gat tgg ctc tga ggc g-NH2 | 1603 |
| r2B2 invader | cga tca tca agg gat ggt ggc ctg tgc | 1604 |
| r2B2 stacker | tga tca atc tcc ttt tgg act ttc tct gc | 1605 |
| SRT | | |
| FRET | | |
| Set 20-21 | | |
| r2B2 probe | ccg tca cgc ctc aga gcc aat cac-NH2 | 1606 |
| r2B2 probe | ccg tca cgc ctc aga gcc aat cac | 1607 |
| r2B2 arrestor | gtg att ggc tct gag gcg-NH2 | 1608 |
| r2B2 invader | cga tca tca agg gat ggt ggc ctg tgc | 1609 |
| r2B2 stacker | ctg atc aat ctc ctt ttg gac ttt ctc tgc g | 1610 |
| SRT | | |
| FRET | | |
| Set 22 | | |
| r2B2 probe | cag tca cgt ctc atg gtc aaa gta ctg tgg-NH2 | 1611 |
| r2B2 invader | gga agt gct cag gat tga agg tgt ctg gc | 1612 |
| r2B2 arrestor | cca cag tac ttt gac cat gag acg-NH2 | 1613 |
| SRT | | |
| FRET | | |
| Set 23 | | |
| r2B2 probe | aac gag gcg cac atg gtc aaa gta ctg tgg-NH2 | 1614 |
| r2B2 arrestor | cca cag tac ttt gac cat gtg cgc-NH2 | 1615 |
| r2B2 invader | gga agt gct cag gat tga agg tgt ctg gc | 1616 |
| SRT | | |
| FRET | | |
| r2B2 probe | cat acg gtt ggg cct gtg aga gc | 1617 |
| r2B2 invader | cat ttt ggt acg atc atc aag gga tgg tc | 1618 |

FIG. 47A-41

| | | |
|---|---|---|
| r3A1 probe | agg agc cac ggg tcc caa atc | 1619 |
| r3A1 probe | FL-agg agc cac ggg tcc caa atc | 1620 |
| r3A1 invader | tcc cct gtt tct tga aaa gtc cat gtg tga | 1621 |
| r3A1 probe | F-tcg cgt agt cgg gtc cca aat c | 1622 |
| r3A1 probe | cat-ctt-cgc-gga-cgg-gtc-cca-aat-c | 1623 |
| r3A1 arrestor | gat-ttg-gga-ccc-ggt-gcg-cc-NH2 | 1624 |
| r3A1 probe | aac-gag-gcg-cac-cgg-gtc-cca-aat-c-NH2 | 1625 |
| r3A1 probe | cat-ctt-cgc-gga-cgg-gtc-cca-aat-c - NH2 | 1626 |
| r3A1 arrestor | gga ttt ggg acc cgt cca cga - NH2 | 1627 |
| r3A1 arrestor | gga-ttt-ggg-acc-cgt-ccg-cg -NH2 | 1628 |
| r3A1 arrestor | gga ttt ggg acc cgt ccg c - NH2 | 1629 |
| r3A1 arrestor | gga ttt ggg acc cgt ccg - NH2 | 1630 |
| r3A1 arrestor | gat-ttg-gga-ccc-ggt-gcg-c-NH2 | 1631 |
| r3A1 arrestor | gat-ttg-gga-ccc-ggt-gcg-NH2 | 1632 |
| r3A1 arrestor | gat-ttg-gga-ccc-ggt-gc-NH2 | 1633 |
| r3A1 arrestor | gat-ttg-gga-ccc-ggt-gcg-cct-NH2 | 1634 |
| r3A1 arrestor | gat-ttg-gga-ccc-ggt-gcg-cct-c-NH2 | 1635 |
| r3A1 probe | aac gag gcg cac cgg gtc cca aat c-Pi | 1636 |
| r3A1 probe | tcc cct gtt tct tga aaa gtc cat gtg tga | 1637 |
| r3A1 invader | aac gag gcg cac cgg gtc cca aat c-NH2 | 1638 |
| r3A1 probe | gat ttg gga ccc ggt gcg-NH2 | 1639 |
| r3A1 arrestor | aac gag gcg cac cgg gtc cca aat c-NH2 | 1640 |
| r3A1 probe | gga ttt ggg acc cgg tgc gc-NH2 | 1641 |
| r3A1 arrestor | aac gag gcg cac cgg gtc cca aat-NH2 | 1642 |
| r3A1 probe | att tgg gac ccg gtg cgc-NH2 | 1643 |
| r3A1 arrestor | ccg tag agg agc acc agg acg | 1644 |
| r3A1 stacker | aac gag gcg cac cgg gtc cca aa-NH2 | 1645 |
| r3A1 probe | ttt ggg acc cgg tgc gc-NH2 | 1646 |
| r3A1 arrestor | tcc gta gag gag cac cag ga | 1647 |
| r3A1 stacker | cag tca cgt ctc cgg gtc cca aa-NH2 | 1648 |
| r3A1 probe | ttt ggg acc cgg aga cg-NH2 | 1649 |
| r3A1 arrestor | tcc gta gag gag cac cag ga | 1650 |
| r3A1 stacker | ccg tca cgc ctc cgg gtc cca aa-NH2 | 1651 |

FIG. 47A-42

| | | |
|---|---|---|
| r3A1 arrestor | ttt ggg acc cgg agg cg-NH2 | 1652 |
| r3A1 stacker | tcc gta gag gag cac cag ga | 1653 |
| r3A1 stacker | tcc gta gag gag cac cag ga | 1654 |
| r3A1 probe | aac gag gcg cac cgg gtc cca-NH2 | 1655 |
| r3A1 arrestor | tgg gac ccg gtg cgc-NH2 | 1656 |
| r3A1 probe | ccg tca cgc ctc cgg gtc cca-NH2 | 1657 |
| r3A1 arrestor | tgg gac ccg gag gcg-NH2 | 1658 |
| r3A1 stacker | aat ccg tag agg agc acc agg | 1659 |
| r3A1 probe | aac gag gcg cac cgg gtc cca | 1660 |
| | | |
| r3A2 invader | ttc ctt gtt tct taa aaa ttc cat gtc taa | 1661 |
| r3A2 invader | att ttt cga tac ttt tta tag cac tcc atc | 1662 |
| r3A2 probe | tgg cgt atc tgg gtt cca agt c | 1663 |
| r3A2 probe | aac gag gcg cac gtc aaa tct ccc taa | 1664 |
| r3A2 arrestor | aac-gag-gcg-cac-tgg-gtt-cca-agt-c | 1665 |
| r3A2 arrestor | tta ggg aga ttt gac gtg cgc c - NH2 | 1666 |
| r3A2 arrestor | gac-ttg-gaa-ccc-agt-gcg-cc-NH2 | 1667 |
| r3A2 probe | aac gac gcg cac tgg gtt cca agt c | 1668 |
| r3A2 arrestor | aac-gag-gcg-cac-tgg-gtt-cca-agt-c-Pi | 1669 |
| r3A2 probe | gac ttg gaa ccc agt gcg-NH2 | 1670 |
| r3A2 probe | aac gag gcg cac tgg gtt cca agt cg-NH2 | 1671 |
| r3A2 arrestor | cga ctt gga acc cag tgc gc-NH2 | 1672 |
| | | |
| r3A2 probe | aac gag gcg cac aac cat caa gtt cta ta-NH2 | 1673 |
| r3A2 invader | gga atc gtc act act gac cct ttg ggt ata aac ac | 1674 |
| r3A2 stacker | tct ttt tta cag act ctc tca agt cta tta cc | 1675 |
| r3A2 arrestor | tat aga act tga tgg ttg tgc gc-NH2 | 1676 |
| r3A2 probe | aac gag gcg cac aac cat caa gtt cta-NH2 | 1677 |
| r3A2 stacker | tat ctt ttt tac aga ctc tct caa gtc tat tac c | 1678 |
| r3A2 arrestor | tag aac ttg atg gtt gtg cgc-NH2 | 1679 |
| | | |
| r3A2 probe | cag tca cgt ctc ctc ggc agg gc-NH2 | 1680 |
| r3A2 invader | cac aat atc gta ggt agg agg tgc ctt aa | 1681 |
| r3A2 arrestor | gcc ctg ccg agg aga cg-NH2 | 1682 |
| r3A2 probe | cag tca cgt ctc ctc ggc agg g-NH2 | 1683 |
| r3A2 stacker | ccc cat cga tct cct g | 1684 |

FIG. 47A-43

| | | |
|---|---|---|
| r3A2 arrestor | ccc tgc cga gga gac g-NH2 | 1685 |
| r3A2 probe | cag tca cgt ctc ctc ggc agg-NH2 | 1686 |
| r3A2 stacker | gcc cca ttg atc tcc tcc | 1687 |
| r3A2 arrestor | cct gcc gag gag acg-NH2 | 1688 |
| r3A2 probe | cag tca cgt ctc ctc ggc ag-NH2 | 1689 |
| r3A2 stacker | ggc ccc atc gat ctc ctc | 1690 |
| r3A2 arrestor | ctg ccg agg aga cg-NH2 | 1691 |
| r3A2 probe | ccg tca cgc ctc ctc ggc agg-NH2 | 1692 |
| r3A2 arrestor | cct gcc gag gcg-NH2 | 1693 |
| r3A2 stacker | gcc cca tcg atc tcc tcc | 1694 |
| r3A2 probe | ccg tca cgc ctc ctc ggc agg | 1695 |
| | | |
| hICAM-1 probe | ccg tca cgc ctc ggc ttg tgt gtt c-NH2 | 1696 |
| hICAM-1 invader | ccg gga tag gtt cag gga ggc gtc | 1697 |
| hICAM-1 stacker | ggt ttc atg ggg gtc cct | 1698 |
| hICAM-1 arrestor | gaa cac aca agc cga ggc g | 1699 |
| | | |
| hVCAM-1 probe | ccg tca cgc ctc gcc ttt gtt tgg-NH2 | 1700 |
| hVCAM-1 arrestor | cca aac aaa ggc gag gcg | 1701 |
| hVCAM-1 invader | ggg caa cat tga cat aaa gtg ttt gcg tac tct c | 1702 |
| hVCAM-1 stacker | gtt cga att cca tgt cat c | 1703 |
| hVCAM-1 probe | ccg tca cgc ctc gcc ttt gtt tg-NH2 | 1704 |
| hVCAM-1 arrestor | caa aca aag gcg agg cg | 1705 |
| hVCAM-1 stacker | ggt tcg aat tcc atg tca tc | 1706 |
| | | |
| hGAPDH probe | aac gag gcg cac gct cct gga aga tg-NH2 | 1707 |
| hGAPDH arrestor | cat ctt cca gga gcg tgc gcc-NH2 | 1708 |
| hGAPDH invader | cac ttg att ttg gag gga tct ca | 1709 |

FIG. 47A-44

| | | | |
|---|---|---|---|
| Secondary system oligos | | | |
| Capture Oligo | aaa agt ggc tcc t-(biotin)c | | 1710 |
| Capture Oligo | aaa aga ggc tcc gct-(biotin)c | | 1711 |
| Capture Oligo | aaa atg tac gcc gct-(biotin) c | | 1712 |
| Capture Oligo | aaa aga tac gcc aca gct-(biotin) c | | 1713 |
| Capture Oligo | aaa acc aac cgt atg aac t-(biotin) c | | 1714 |
| Capture Oligo | aaa atc ata cgc cac t-(biotin)c | | 1715 |
| SRT | cgg-agg-aag-cag-ttg-gtg-tgc-ctc-gtt-gcc-tt-NH2 | | 1716 |
| SRT | cgg agg aag cag ttg gtg ccc ctc ctc gtt aa-NH2 | | 1717 |
| SRT | cgg aag aag cag ttg gtg cgc ctc gtt aa-NH2 | | 1718 |
| SRT | cgg aag aag cag ttg gtg cgc ctc gtt aa-NH2 | | 1719 |
| SRT | cgg aag aag cag ttg gtg cgc ctc gtt aa | | 1720 |
| SRT | cgg aag aag cag ttg gtg cgc ctc gtt aa | | 1721 |
| SRT | cgg aag aag cag ttg gtg cgc ctc gtt aa | | 1722 |
| SRT | cgg aag aag cag ttg gag gcg tga cgg t-NH2 | | 1723 |
| SRT | cgg aag aag cag ttg gag gcg tga cgg a-NH2 | | 1724 |
| SRT | cgg aag aag cag ttg gag gcg tga cgg a | | 1725 |
| SRT | cgg aag aag cag ttg gag gcg tga cgg t | | 1726 |
| SRT | cgg aag aag cag ttg gag gcg tga cgg t | | 1727 |
| SRT | cgg aag aag cag ttg gag gcg tga cgg t | | 1728 |
| SRT | cgg aag aag cag ttg gag gcg tga cgg a | | 1729 |
| FRET probe | FL-caa c(cy3)gc ttc ctc | | 1730 |
| FRET probe | FL-caa c(cy3)gc ttc ctc c | | 1731 |
| FRET probe | FL-caa-c(cy3)g-ctt-cct-ccg | | 1732 |
| FRET probe | FL-caa-c(cy3)g-ctt-cct-ccg-uu | | 1733 |
| FRET probe | FL-caa-c(cy3)g-ctt-cct-ccg-uuu-u | | 1734 |
| FRET probe | FL-caa-c(cy3)g-ctt-cct-ccg-NH2 | | 1735 |

FIG. 47A-45

Oligo sequence descriptions:
5' to 3' direction, 2'-Ome nts are bolded and underlined, internal modifications are defined in ( ), ASR of primary probes are underlined
C18ddC = C18 linker+dideoxy C,  ddC = dideoxy C,  Fl = Fluorescein

| Oligo Type | Oligo Sequence | SEQ ID NO |
|---|---|---|
| HUMAN IL-2 | | |
| Human IL-2 Probe | Fl- CGAAATTAATACGCCTTCTTGGGCATGTAC -C18ddC | 1736 |
| Human IL-2 Probe | CGAAATTAATACGCCTTCTTGGGCATGTAC -C18ddC | 1737 |
| Human IL-2 Invader | CTGAAGATGTTTCAGTTCTGTG- ddC | 1738 |
| Human IL-2 Invader | GAAGATGTTTCAGTTCTGTGGC | 1739 |
| Human IL-2 Probe | TCACTTCCTACCTTCTTGGGCATGTAA | 1740 |
| Human IL-2 Probe | TCACTTCCTACCTTCTTGGGCATGTAAAAC | 1741 |
| Human IL-2 Probe | TCACTTCCTACCTTCTTGGGCATGTAA- C18ddC | 1742 |
| Human IL-2 Invader | GAAGATGTTTCAGTTCTGTGG- ddC | 1743 |
| Human IL-2 Probe | Fl- ACTTCCTACTTAATTCCATTCAAAATC | 1744 |
| Human IL-2 Probe | ACTTCCTACTTAATTCCATTCAAAATC - C18ddC | 1745 |
| Human IL-2 Invader | GAGTTTGGGATTCTTGTAATTAT- ddC | 1746 |
| Human IL-2 Probe | Fl- CGTGTTCTGTGGCGTATCTTAATTCCATTCAAAATC | 1747 |
| Human IL-2 Probe | CGTGTTCTGTGGCGTATCTTAATTCCATTCAAAATC | 1748 |
| Human IL-2 Invader | GAGTTTGGGATTCTTGTAATTAT - ddC | 1749 |
| Human IL-2 Probe | Fl- CGTGTTCTGTGGCGTATCTTAATTCCATTCAAAATCATCTG | 1750 |
| Human IL-2 Probe | CGTGTTCTGTGGCGTATCTTAATTCCATTCAAAATCATCTG | 1751 |
| Human IL-2 Probe | Fl- CGTGTTCTGTGGCGTATCTTAATTCCATTCAAAATCATC | 1752 |
| Human IL-2 Probe | CGTGTTCTGTGGCGTATCTTAATTCCATTCAAAATCATC | 1753 |
| Human IL-2 Invader | GAGTTTGGGATTCTTGTAATTAT-ddC | 1754 |
| HUMAN β-ACTIN | | |
| Human β-actin Probe | Fl-TTCCTACTCTTGATCTTCATTGTGC | 1755 |
| Human β-actin Invader | CTCAGGAGGAGCAATGATCTT | 1756 |
| Human β-actin Invader | CTCAGGAGGAGCAATGAT | 1757 |
| Human β-actin Probe | Fl-TCACTTCCTACTCTGGGTCATCTTCTCG -C18ddC | 1758 |
| Human β-actin Probe | TCACTTCCTACTCTGGGTCATCTTCTCG -C18ddC | 1759 |
| Human β-actin Invader | GTGTTGAAGGTCTCAAACATGAT- ddC | 1760 |
| Human β-actin Probe | GGGTGTTGAAGGTCTCAAACATGAT - ddC | 1761 |
| Human β-actin Probe | Fl- CGTGTTCTGTGGCGTATCTGGGTCATCTTCTCG | 1762 |
| Human β-actin Probe | CGTGTTCTGTGGCGTATCTGGGTCATCTTCTCG | 1763 |
| Human β-actin Invader | GGGTGTTGAAGGTCTCAAACATGAT- ddC | 1764 |

FIG. 47A-46

GAPDH

| | | |
|---|---|---|
| Human GAPDH Probe | Fl- TTCATACGGTTGGTAGTTGAGGTCAATG | 1765 |
| Human GAPDH Probe | TTCATACGGTTGGTAGTTGAGGTCAATG | 1766 |
| Human GAPDH Invader | GGAATCATATTGGAACATGTAAACCATC | 1767 |
| Human GAPDH Probe | Fl- TTCATACGGTTGGCTCCTGGAAGATG | 1768 |
| Human GAPDH Probe | TTCATACGGTTGGCTCCTGGAAGATG | 1769 |
| Human GAPDH Invader | CACTTGATTTTGGAGGGATCTCA | 1770 |
| Human/Mouse/Rat GAPDH Probe | TTCATACGGTTGGTAGTTGAGGTCAATG | 1771 |
| Mouse/Rat GAPDH Invader | AGAATCATACTGGAACATGTAGACCATC | 1772 |
| Mouse GAPDH Probe | Fl-TGGCGTATCATGTAGTTGA | 1773 |
| Mouse GAPDH Probe | TGGCGTATCATGTAGTTGA | 1774 |
| Mouse GAPDH Invader | GGAGTCATACTGGAACATGTAGACC | 1775 |
| Mouse GAPDH Probe | TGGCGTATCATGTAGTTGA | 1776 |
| Mouse GAPDH Invader | AGTACATACTGGAACATGTAGACA | 1777 |
| Mouse GAPDH Invader | GGAGTCATACTGGAACATGTAGACA | 1778 |

MOUSE IL-6

| | | |
|---|---|---|
| Mouse IL-6 Probe | Fl- TGGCGTATCTCTTTTCTCATT | 1779 |
| Mouse IL-6 Probe | TGGCGTATCTCTTTTCTCATT | 1780 |
| Mouse IL-6 Invader | ACAATCAGAATTGCCATTGCACAACA | 1781 |

MOUSE ONCOSTATIN M

| | | |
|---|---|---|
| Mouse Oncostatin M Probe | Fl-GAAGGCAGAGGACCGTGAGGC | 1782 |
| Mouse Oncostatin M Probe | GAAGGCAGAGGACCGTGAGGC | 1783 |
| Mouse Oncostatin M Invader | AAGACATCTGGTGTTGTAGTGA | 1784 |
| Mouse Oncostatin M Probe | Fl-TGGCGTATCTCCCCAGAGAAAGC | 1785 |
| Mouse Oncostatin M Probe | TGGCGTATCTCCCCAGAGAAAGC | 1786 |
| Mouse Oncostatin M Invader | CACTGAGCCGATGAAGCGATGGTAA | 1787 |
| Mouse Oncostatin M Probe | Fl- TGGCGTATCTAGGGCTCCAAGAG | 1788 |
| Mouse Oncostatin M Probe | TGGCGTATCTAGGGCTCCAAGAG | 1789 |
| Mouse Oncostatin M Invader | GTGTTCAGGTTTTGGAGGCGGATAA | 1790 |
| Mouse Oncostatin M Probe | Fl-TGGCGTATCTAGGGCTCCAAG | 1791 |
| Mouse Oncostatin M Probe | TGGCGTATCTAGGGCTCCAAG | 1792 |
| Mouse Oncostatin M Invader | GTGTTCAGGTTTTGGAGGCGGATAA | 1793 |
| FRET Probe | Fl-ATTC(CY3)TCTCAGA-3'NH2 | 1794 |
| FRET Probe | Fl-ATTC(CY3)TCTCAGAC-3'NH2 | 1795 |
| FRET Probe | Fl-ATTC(CY3)TCTCAGACT-3'NH2 | 1796 |

FIG. 47A-47

| | | |
|---|---|---|
| SRT | CAGTCTGAGATGAATGATACGCCAGG-3'NH2 | 1797 |
| Mouse Oncostatin M Arrestor | CTTGGAGCCCTAGATA-NH2 | 1798 |
| Mouse Oncostatin M Arrestor | CTTGGAGCCCTAGAT-NH2 | 1799 |
| Mouse Oncostatin M Arrestor | CTTGGAGCCCTAGA-NH2 | 1800 |
| Mouse Oncostatin M Probe | CTGGCGTATCTAGGGCTCCA | 1801 |
| Mouse Oncostatin M Probe | CCTGGCGTATCTAGGGCTCCA | 1802 |
| Mouse Oncostatin M Invader | GTGTTCAGGTTTTGGAGGCGGATAA | 1803 |
| SRT | CAGTCTGAGATGAATGATACGCCAGG-3'NH2 | 1804 |
| Arrestor | CTTGGAGCCCTAGAT-NH2 | 1805 |
| Mouse Oncostatin M Probe | Fl-CTCTCTCGTCTCTAGGGCTCCA | 1806 |
| Mouse Oncostatin M Probe | CTCTCTCGTCTCTAGGGCTCCA | 1807 |
| Mouse Oncostatin M Invader | GTGTTCAGGTTTTGGAGGCGGATAA | 1808 |
| SRT | CAGTCTGAGATGAATGAGACGAGAGAGT-NH2 | 1809 |
| Mouse Oncostatin M Arrestor | CTTGGAGCCCTAGAG-NH2 | 1810 |
| Mouse Oncostatin M Probe | Fl-TGGCGTATCTAGGGCTCCA | 1811 |
| Mouse Oncostatin M Probe | TGGCGTATCTAGGGCTCCA | 1812 |
| Mouse Oncostatin M Invader | GTGTTCAGGTTTTGGAGGCGGATAA | 1813 |
| Mouse Oncostatin M Probe | TGGCGTATCTCCCCAGAGAAA | 1814 |
| Mouse Oncostatin M Probe | TGGCGTATCTCCCCAGAGA | 1815 |
| Mouse Oncostatin M Invader | CACTGAGCCGATGAAGCGATGGTAA | 1816 |
| Mouse Oncostatin M Probe | TGGCGTATCTATAGGGCTC | 1817 |
| Mouse Oncostatin M Invader | GTGTGTTCAGGTTTTGGAGGCGGAA | 1818 |
| Mouse Oncostatin M Probe | CTCTCTCGTCTCTTCAGGTTTG | 1819 |
| Mouse Oncostatin M Invader | GGCAGCTCTCAGGTCAGGTGTGA | 1820 |
| Mouse Oncostatin M Invader | AGGCAGCTCTCAGGTCAGGTGTGA | 1821 |
| SRT | CAGTCTGAGATGAATGAGACGAGAGAGT-NH2 | 1822 |
| FRET Probe | Fl-ATTC(CY3)TCTCAGAC-3'NH2 | 1823 |
| Mouse Oncostatin M Arrestor | CAAAACCTGAAGAGA-3'NH2 | 1824 |
| Mouse Oncostatin M Arrestor | CAAAACCTGAAGAGAGAC-3'NH2 | 1825 |
| Mouse Oncostatin M Arrestor | CAAAACCTGAAGAGACG-3'NH2 | 1826 |
| Mouse Oncostatin M Probe | Fl-CTCTCTCGTCTCTTCAGGTTTG | 1827 |
| Mouse Oncostatin M Probe | CTCTCTCGTCTCTTCAGGTTTG-NH2 | 1828 |
| Mouse Oncostatin M Invader | GGCAGCTCTCAGGTCAGGTGTGA | 1829 |
| Mouse Oncostatin M Stacker | GAGGGCGGATATAGGGCT- Biotin TEG | 1830 |

FIG. 47A-48

| | | |
|---|---|---|
| HUMAN ONCOSTATIN M | | |
| Human Oncostatin M Probe | CTCTCTCGTCTCTTCTAAGGACTTA | 1831 |
| Human Oncostatin M Probe | CTCTCTCGTCTCTTCTAAGGACTTAC | 1832 |
| Human Oncostatin M Invader | GAAACAGGAGTGCAAGGACCAGACA | 1833 |
| Human Oncostatin M Probe | TCACGTCTCTTCAGGTTTTG | 1834 |
| Human Oncostatin M Probe | GTCACGTCTCTTCAGGTTTTG | 1835 |
| Human Oncostatin M Probe | AGTCACGTCTCTTCAGGTTTTG | 1836 |
| Human Oncostatin M Probe | CAGTCACGTCTCTTCAGGTTTTG | 1837 |
| Human Oncostatin M Invader | AGGCAGCTCTCAGGTCAGGTGTGA | 1838 |
| Fret Probe 1 | FI-CAAC(CY3)GCTTCCTCCG | 1839 |
| SRT | CGGAGGAAGCAGTTGGAGACGTGACTGT<u>GG</u>-NH2 | 1840 |
| SRT with mismatch | CGGAAGAAGCAGTTGGAGACGTGACTGACTGT<u>GG</u>-NH2 | 1841 |
| SRT with mismatch | CGGACGAAGCAGTTGGAGACGTGACTGACTGT<u>GG</u>-NH2 | 1842 |

FIG. 47A-49 bold indicates 2' o-methyl bases

| Oligo Type | Oligo Sequence | Oligo # | SEQ ID NO |
|---|---|---|---|
| SECONDARY SYSTEM: | | | |
| SET 1 | | | |
| FRET probe 1 | 5'-F-CAAC(CY3)GCTTCCTCCG-3' | DB04001F6 | 1843 |
| secondary target | 5'-CGGAAGAAGCAGTTGGTGCGCCCTCGTTAA-NH2 | 649-10-01 | 1844 |
| SET 2 | | | |
| FRET probe 1 | 5'-F-CAAC(CY3)GCTTCCTCCG-3' | DB04001F6 | 1845 |
| secondary target | 5'-CGGAAGAAGCAGTTGGAGGCGTGACGGT-NH2-3' | 641-60-03 | 1846 |
| h2C19 designs 2 | | | |
| probe | 5'-AACGAGGCGCACGATGTCCATCGA-NH2-3' | 971-26-09 | 1847 |
| stacker | 5'-TTCTTGGTGTTCTTTACTTTCTC-3' | 971-26-12 | 1848 |
| invader | 5'-GCAATCAATAAAGTCCCGAGGGTTGTTC | 971-26-11 | 1849 |
| arrestor SET 1 | 5'-TCGATGGACATCGTGCGC-3' | 971-26-10 | 1850 |
| h 2D6 p450 designs | | | |
| probe | 5'-CCGTCACGCCTCTCACCCATCT-NH2-3' | 971-11-01 | 1851 |
| stacker | 5'-CTGGTCGCCGCACCT-3' | 971-11-04 | 1852 |
| invader | 5'-TGTAGGGCATGTGAGCCTGGA-3' | 971-11-03 | 1853 |
| arrestor SET 2 | 5'-AGATGGGAGAGAGGCG-3' | 971-11-02 | 1854 |
| probe | 5'-CCGTCACGCCTCGAAGCCCTGT-NH2-3' | 971-11-05 | 1855 |
| stacker | 5'-ACTTCGATGTCACGGGATGTCATATGG-3' | 971-11-08 | 1856 |
| invader | 5'-GAGTGTCGTTCCCTTAGGGATGCGC-3' | 971-11-08 | 1857 |
| arrestor SET 2 | 5'-ACAGGGCTTCGAGGCG-3' | 971-11-06 | 1858 |

FIG. 47A-50

| | | | |
|---|---|---|---|
| probe | 5'-CCGTCACGCCTCCCTGCTGAGAAAG-NH2-3' | 971-11-09 | 1859 |
| stacker | 5'-GCAGGAAGGCCTCCG-3' | 971-11-12 | 1860 |
| invader | 5'-CCCGAGGCATGCACGGCGGA-3' | 971-11-11 | 1861 |
| arrestor | 5'-CTTTCTCAGCAGGGAGGCG-3' | 971-11-10 | 1862 |
| SET 2 | | | | h 2D6 shroter designs

| | | | |
|---|---|---|---|
| probe | 5'-CCGTCACGCCTCCCTGCTGAGAAA-HEX-3' | 1051-12-06 | 1863 |
| probe | 5'-CCGTCACGCCTCCCTGCTGAGAAA-3' | 1051-12-05 | 1864 |
| probe | 5'-CCGTCACGCCTCCCTGCTGAGAAA-NH2-3' | 971-38-01 | 1865 |
| invader | 5'-CCCGAGGCATGCACGGCGGA-3' | 971-11-11 | 1866 |
| stacker | 5'-GGCAGGAAGGCCTCC-3' | 971-38-03 | 1867 |
| arrestor | 5'-TTTCTCAGCAGGGAGGCG-3' | 971-38-02 | 1868 |
| SET 2 | | | |

| | | | |
|---|---|---|---|
| probe | 5'-CCGTCACGCCTCCCTGCTGAGA-NH2-3' | 971-38-07 | 1869 |
| invader | | 971-11-11 | 1870 |
| stacker | 5'-AAGGCAGGAAGGCCTCC-3' | 971-38-09 | 1871 |
| arrestor | 5'-TCTCAGCAGGGAGGCG-3' | 971-38-08 | |
| SET 2 | | | |

| | | | |
|---|---|---|---|
| probe | 5'-CCGTCACGCCTCCCTGCTGAGAA-NH2-3' | 971-38-04 | 1872 |
| invader | | 971-11-11 | 1873 |
| stacker | 5'-AGGCAGGAAGGCCTGG-3' | 971-38-06 | 1874 |
| arrestor | 5'-TTCTCAGCAGGGAGGCG-3' | 971-38-05 | |
| SET 2 | | | |

| | | | |
|---|---|---|---|
| probe | 5'-CCGTCACGCCTCCCTGCTGAGAAAG-NH2-3' | 971-11-09 | 1875 |
| invader | | 971-11-11 | |
| stacker | 5'-GCAGGAAGGCCTCCG-3' | 971-11-12 | 1876 |
| arrestor | 5'-CTTTCTCAGCAGGGAGGCG-3' | 971-11-10 | 1877 |
| SET 2 | | | |

FIG. 47A-51 h 2B6 p450 alt. Splice designs

| | Sequence | ID | SEQ ID NO |
|---|---|---|---|
| probe | 5'-AACGAGGCGCACCACCATATCCC-NH2-3' | 1051-48-01 | 1878 |
| invader | 5'-CCAGCGGTTTCCATTGGCAAAGATCAA-3' | 971-01-03 | 1879 |
| stacker | 5'-CGGAAGAATGGGTCGACCATG-3' | 971-01-04 | 1880 |
| arrestor | 5'-GGGATATGGTGGTGCGC-3' | 1051-48-02 | 1881 |
| SET 1 | | | |
| probe | 5'-CCGTCACGCCTCCACCATATCCC-HEX-3' | 1051-12-02 | 1882 |
| probe | 5'-CCGTCACGCCTCCACCATATCCC-3' | 1051-12-01 | 1883 |
| probe | 5'-CCGTCACGCCTCCACCATATCCC-NH2-3' | 971-01-01 | 1884 |
| invader | | 971-01-03 | |
| stacker | | 971-01-04 | |
| arrestor | 5'-GGGATATGGTGAGGCG-3' | 971-01-02 | 1885 |
| SET 2 | | | |
| probe | 5'-AACGAGGCGCACCAGAGCTGATGAG-NH2-3' | 1051-48-03 | 1886 |
| invader | 5'-GAGAAGAGCTCAAACAGCTGGCCGAATAA-3' | 971-01-10 | 1887 |
| stacker | 5'-TGAAAAAGTCTGGTAGAACAAGTTCAGC-3' | 971-01-11 | 1888 |
| arrestor | 5'-CTCATCAGCTCTGGTGCGC-3' | 1051-48-04 | 1889 |
| SET 1 | | | |
| probe | 5'-CCGTCACGCCTCCAGAGCTGATGAG-NH2-3' | 971-01-08 | 1890 |
| | | 971-01-10 | |
| | | 971-01-11 | |
| | 5'-CTCATCAGCTCTGGAGGCG-3' | 971-01-09 | 1891 |
| SET 2 | | | | h 2B6 p450 alt.splice designs2

| | Sequence | ID | SEQ ID NO |
|---|---|---|---|
| p | 5'-AACGAGGCGCACCCTTGGATTTC-NH2-3' | 1051-48-05 | 1892 |
| i | 5'-CTGTTCAATCTCCCTGTAGACTCTCTA-3' | 1051-48-10 | 1893 |
| s | 5'-CGAAGCTCCTCTATCAG-3' | 1051-48-09 | 1894 |
| a | 5'-GAAATCCAAGGGTGCGC-3' | 1051-48-06 | 1895 |
| SET 1 | | | |

FIG. 47A-52

| | Sequence | ID | SEQ ID NO |
|---|---|---|---|
| p | 5'-CCGTCACGCCTCCCTTGGATTTC-NH2-3' | 1051-48-07 | 1896 |
| i | | 1051-48-10 | |
| s | | 1051-48-09 | |
| a | 5'-GAAATCCAAGGGAGGCG-3' | 1051-48-08 | 1897 |
| SET 2 | | | |
| p | 5'-AACGAGGGCGCACTGAGGGCC-NH2-3' | 1051-48-11 | 1898 |
| i | 5'-GGAAGAGGAAGGTGGGGTCCAA-3' | 1051-48-16 | 1899 |
| s | 5'-CCCTTGGATTTCCGAAG-3' | 1051-48-15 | 1900 |
| a | 5'-GGCCCTCAGTGCGC-3' | 1051-48-12 | 1901 |
| SET 1 | | | |
| p | 5'-CCGTCACGCCTCTGAGGGCC-NH2-3' | 1051-48-13 | 1902 |
| i | | 1051-48-16 | |
| s | | 1051-48-15 | |
| a | 5'-GGCCCTCAGAGGCG-3' | 1051-48-14 | 1903 |
| SET 2 | | | | h2B6 p450 alt. Splice designs4

| | Sequence | ID | SEQ ID NO |
|---|---|---|---|
| probe | 5'-AACGAGGGCGCACAATACAGAGCTG-NH2-3' | 1051-48-17 | 1904 |
| invader | 5'-GAGAAGAGCTCAAACAGCTGGCCGC-3' | 1051-48-22 | 1905 |
| stacker | 5'-ATGAGTGAAAAAGTCTGGTAGAAC-3' | 1051-48-21 | 1906 |
| arrestor | 5'-CAGCTCTGTATTGTGCGC-3' | 1051-48-18 | 1907 |
| SET 1 | | | |
| probe | 5'-CCGTCACGCCTCAATACAGAGCTG-NH2-3' | 1051-48-19 | 1908 |
| invader | | 1051-48-22 | |
| stacker | | 1051-48-21 | |
| arrestor | 5'-CAGCTCTGTATTGAGGCG-3' | 1051-48-20 | 1909 |
| SET 2 | | | |
| probe | 5'-AACGAGGGCGCACGGTTGAGGTTCTG-NH2-3' | 1051-48-23 | 1910 |
| invader | 5'-CAGCAAAGAAGAGCGAGAGCGTGTTGAC-3' | 1051-48-28 | 1911 |
| stacker | 5'-GTGGCTGAATTCACTGTG-3' | 1051-48-27 | 1912 |
| arrestor | 5'-CAGAACCTCAACCGTGCGC-3' | 1051-48-24 | 1913 |
| SET 1 | | | |

FIG. 47A-53

| | | | |
|---|---|---|---|
| probe | 5'-CCGTCACGCCTCGGTTGAGGTTCTG-NH2-3' | 1051-48-25 | 1914 |
| invader | | 1051-48-28 | |
| stacker | | 1051-48-27 | |
| arrestor | 5'-CAGAACCTCAACCGAGGCG-3' | 1051-48-26 | 1915 |
| SET 2 | | | | h2B6 p450 designs

| | | | |
|---|---|---|---|
| probe | 5'-CCGTCACGCCTCCACCATATCCCG-NH2-3' | 971-01-06 | 1916 |
| invader | 5'-CCGTCACGCCTCCACCATATCCC-NH2-3' | 971-01-03 | 1917 |
| stacker | 5'-CGGAAGAATGGGTCGAC-3' | 971-01-05 | 1918 |
| stacker | 5'-CGGAAGAATGGGTCGACCATG-3' | 971-01-04 | 1919 |
| arrestor | 5'-GGGATATGGTGGAGGCG-3' | 971-01-02 | 1920 |
| SET 2 | | | |
| probe | 5'-CCAGCGGTTTCCATTGGCAAAGATCAA-3' | 971-01-01 | 1921 |
| invader | | 971-01-03 | |
| arrestor | 5'-CGGGGATATGGTGGAGGCG-3' | 971-01-07 | 1922 |
| SET 2 | | | |
| probe | 5'-CCGTCACGCCCTCCAGAGCTGATGAG-NH2-3' | 971-01-08 | 1923 |
| invader | 5'-GAGAAGAGCTCAAACAGCTGGCCGAATAA-3' | 971-01-10 | 1924 |
| stacker | 5'-TGAAAAAGTCTGGTAGAACAAGTTCAGC-3' | 971-01-11 | 1925 |
| arrestor | 5'-CTCATCAGCTCTGGAGGCG-3' | 971-01-09 | 1926 |
| SET 2 | | | | h2b6p450 designs 2

| | | | |
|---|---|---|---|
| probe | 5'-CCGTCACGCCTCAGATGACTGCC-NH2-3' | 971-01-12 | 1927 |
| invader | 5'-GGAGAAGGTCGGAAAATCTCTGAATCTCATC-3' | 971-01-13 | 1928 |
| stacker | 5'-TCTGTGTATGGCATTTGGCTCGG-3' | 971-01-14 | 1929 |
| arrestor | 5'-GGCAGTCATCTGAGGCG-3' | 971-01-15 | 1930 |
| SET 2 | | | |

FIG. 47A-54 h 2C19 designs 1

| | Sequence | ID | SEQ ID NO |
|---|---|---|---|
| probe | 5'-CCGTCACGCCTCCATCCTTAATATCTAT-NH2-3' | 971-26-01 | 1931 |
| invader | 5'-GAGAGATTGGTTAAGGATTTGCTGAA-3' | 971-26-03 | 1932 |
| stacker | 5'-CTGTAGGATATTTCCAATCACTGGG-3' | 971-26-04 | 1933 |
| arrestor | 5'-ATAGATATTAAGGATGGAGGCG-3' | 971-26-02 | 1934 |
| SET 2 | | | |

| | | | |
|---|---|---|---|
| probe | 5'-AACGAGGCGCACCGTTCCAGGC-NH2-3' | 971-26-05 | 1935 |
| invader | 5'-CATATCCATGCAGCACCACCATGA-3' | 971-26-07 | 1936 |
| stacker | 5'-CAAAATACAGAGTGAACACAGGGCC-3' | 971-26-08 | 1937 |
| arrestor | 5'-GCCTGGAACGGTGCGC-3' | 971-26-06 | 1938 |
| SET 1 | | | | h2C19 shorter site 2 designs

| | | | |
|---|---|---|---|
| probe | 5'-AACGAGGCGCACCGTTCCAGG-NH2-3' | 971-68-01 | 1939 |
| invader | 5'-CATATCCATGCAGCACCACCATGA-3' | 971-26-07 | 1940 |
| stacker | 5'-CCAAAATACAGAGTGAACACAGGGCC-3' | 971-68-03 | 1941 |
| arrestor | 5'-CCTGGAACGGTGCGC-3' | 971-68-02 | 1942 |
| SET 1 | | | |

| | | | |
|---|---|---|---|
| probe | 5'-AACGAGGCGCACCGTTCCAGGC-NH2-3' | 971-26-05 | 1943 |
| probe | 5'-AACGAGGCGCACCGTTCCAGGC-3' | 1051-12-03 | 1944 |
| probe | 5'-AACGAGGCGCACCGTTCCAGGC-HEX-3' | 1051-12-04 | 1945 |
| invader | 5'-CAAAATACAGAGTGAACACAGGGCC-3' | 971-26-07 | |
| stacker | 5'-GCCTGGAACGGTGCGC-3' | 971-68-04 | 1946 |
| arrestor | | 971-26-05 | 1947 |
| SET 1 | | | | rat 1A1, rat 1A2

Rat 1A1 site 1 bs. 639-700

| | | | |
|---|---|---|---|
| probe | 5'-CCGTCACGCCCTCAGATTGACTATGCTG-NH2-3' | 500-58-01 | 1948 |
| invader | 5'-CAGTAACCTCCCAAACTCATTGCTTC-3' | 500-58-03 | 1949 |
| stacker | 5'-AGCAGCTCTTGGTCATCGT-3' | 500-58-04 | 1950 |
| arrestor | 5'-CAGCATAGTCAATCTGAGGCG-3' | 500-58-02 | 1951 |
| SET 2 | | | |

FIG. 47A-55 rat 1A2 — Rat 1A2 site 1 bs. 674-725

| | | |
|---|---|---|
| probe | 5'-AACGAGGCGCACTGACATTCTCCAC-NH2-3' | 500-58-05 | 1952
| invader | 5'-GTCCACAGCATTCCCTGAGGA-3' | 500-58-07 | 1953
| stacker | 5'-AAAGTCCTTGCTGCTCTC-3' | 500-58-08 | 1954
| arrestor | 5'-GTGGAGAATGTCAGTGCGC-3' | 500-53-06 | 1955
| SET 1 | | | rat 2B1-2B2 patent

| | | |
|---|---|---|
| probe | 5'-AACGAGGCGCACTGGCTTGACACA-NH2-3' | 500-49-05 | 1956
| invader | 5'-GTCAATGTCCTTGGGAGCCAAAA-3' | 500-49-03 | 1957
| stacker | 5'-GAGAAGTTCTGGAGGATGGTGG-3' | r2B1, 2B2  500-49-07 | 1958
| arrestor | 5'-TGTGTCAAGCCAGTGCGC-3' | 500-49-06 | 1959
| SET 1 | | |

| | | |
|---|---|---|
| probe | 5'-AACGAGGCGCACTGGCTTGACACAG-NH2-3' | 500-49-01 | 1960
| invader | | 500-49-03 | |
| stacker | 5'-AGAAGTTCTGGAGGATGGTGG-3' | r2B1, 2B2  500-49-04 | 1961
| arrestor | 5'-CTGTGTCAAGCCAGTGCGC-3' | 500-49-02 | 1962
| SET 1 | | | rat 2B1-2B2 site 4 — PROBE SET 2 (r2B1 bs 1299-1353, r2B2 bs. 474-528)

| | | |
|---|---|---|
| probe | 5'-AACGAGGCGCACGAGGAACAATTCATTT-NH2-3' | 500-49-12 | 1963
| invader | 5'-GTTCTGGAGGATGGTGGTGAAGAAC-3' | 500-49-10 | 1964
| stacker | 5'-CGGGCAATGCCTTCG-3' | 500-49-14 | 1965
| arrestor | 5'-AAATGAATTGTTCCTCGTGCGC-3' | 500-49-13 | 1966
| SET 2 | | |

| | | |
|---|---|---|
| probe | 5'-AACGAGGCGCACGAGGAACAATTCATTTC-NH2-3' | 500-49-08 | 1967
| invader | | 500-49-10 | |
| stacker | 5'-GGGCAATGCCTTCG-3' | 500-49-11 | 1968
| arrestor | 5'-GAAATGAATTGTTCCTCGTGCGC-3' | 500-49-09 | 1969
| SET 1 | | |

FIG. 47A-56 rat 2B1-2B2 ,5 patent

| | | |
|---|---|---|
| probe | 5'-AACGAGGCGCACAGCTGAGAAGCAG-NH2-3' | 500-49-15 |
| invader | 5'-GCCTCAGCCGGATCACCGC-3' | r2B1, 500-49-17 |
| invader | 5'-GCCTCAGCCCGATCACCGC-3' | r2B2, 500-49-18 |
| stacker | 5'-ATCTGGTACGTTGGAGGTATT-3' | r2B1 500-49-20 |
| stacker | 5'-ATCTGGTATGTTGGAGGTATT-3' | r2B2 500-49-21 |
| arrestor | 5'-CTGCTTCTCAGCTCTGCGC-3' | 500-49-16 |

NOTE: all 3 invader/probe sets are designed to detect both 2B1 and 2B2
SET 1 rat 2E1 p450 (afo61442) 500-73     Rat 2E1 PROBE SET (570C)

| | | |
|---|---|---|
| p | 5'-CCGTCACGCCTCGTCGAAACGTTTGTT-NH2 | 500-40-04 |
| i | 5'-CCTCAGACACTTCTGTCATTGTAC-3' | 500-40-02 |
| s | 5'-GAAGAGGATATCCGCAATGACATTGC-3' | 500-40-05 |
| a | 5'-AACAAACGTTTCGACGAGGCG-3' | 500-40-06 |

SET 2

| | | |
|---|---|---|
| p | 5'-CCGTCACGCCTCGTCGAAACGTTTGTTGAAG-NH2-3' | 500-40-01 |
| i | | 500-40-02 |
| s | | 500-40-05 |
| a | 5'-CTTCAACAAACGTTTCGACGAGGCG-3' | 500-40-03 |

SET 2 rat 2E1 p450 (afo61442) 500-73     Rat 2E1 PROBE SET (822G) (designed over splice junction #5)

| | | |
|---|---|---|
| p | 5'-CCGTCACGCCTCCTCCATCTCTATG-NH2-3' | 500-40-10 |
| i | 5'-GTTCTTGGCTGTGTTTTTCCTTA-3' | 500-40-08 |
| s | 5'-AGGAGACAGTCAGTCACATC-3' | 500-40-11 |
| a | 5'-CATAGAGATGGAGGAGGCG-3' | 500-40-12 |

SET 2

| | | |
|---|---|---|
| p | 5'-CCGTCACGCCTCCTCCATCTCTATGAG-NH2-3' | 500-40-07 |
| i | | 500-40-08 |
| s | | 500-40-11 |
| a | 5'-CTCATAGAGATGGAGGAGGCG-3' | 500-40-09 |

FIG. 47A-57

| | | | SEQ ID |
|---|---|---|---|
| SET 2 | | | |
| Rat 2E1 PROBE SET (969G) | Designed over splice junction #6 | | |
| probe | 5'-CCGTCACGCCTCCTCTTCAATTTCTG-HEX-3' | 1073-19-06 | 1988 |
| invader | 5'-CCCTGTCAATTTCTTCATGAAGTTTA-3' | 500-40-14 | 1989 |
| stacker | 5'-GGTATTTCATGAGGATCAGGAGC-3' | 500-40-17 | 1990 |
| arrestor | 5'-CCAGAAATTGAAGAGGAGGCG-3' | 500-40-15 | 1991 |
| SET 2 | | | |
| probe | 5'-CCGTCACGCCTCCTCTTCAATTTCTG-3' | 1073-19-05 | 1992 |
| probe | 5'-CCGTCACGCCTCCTCTTCAATTTCTG-NH2-3' | 500-40-16 | 1993 |
| probe | 5'-CCGTCACGCCTCCTCTTCAATTTCTGG-NH2 | 500-40-13 | 1994 |
| invader | | 500-40-14 | |
| stacker | | 500-40-17 | |
| arrestor | 5'-CAGAAATTGAAGAGGAGGCG-3' | 500-40-18 | 1995 |
| SET 2 | | | |
| Rat 2E1 PROBE SET (969G) | Designed over splice junction #6 | | |
| probe | 5'-CCGTCACGCCTCCTCTTCAATTTCT-NH2-3' | 500-73-01 | 1996 |
| invader | 5'-CCCTGTCAATTTCTTCATGAAGTTTA-3' | 500-40-14 | 1997 |
| stacker | 5'-GGGTATTTCATGAGGATCAGGAG-3' | 500-73-03 | 1998 |
| arrestor | 5'-AGAAATTGAAGAGGAGGCG-3' | 500-73-02 | 1999 |
| SET 2 | | | |
| rat 3A's design 2 | | | |
| probe | 5'-CCGTCACGCCTCGTTCCTGGGT-NH2-3' | 500-43-15 | 2000 |
| invader | 5'-GAGCAAACCTCATGCCAATGCAC-3' | r3A1, 3A2, 3A18  500-43-23 | 2001 |
| invader | 5'-GAGCAAACCTCATGTCAATGCAC-3' | r3A2  500-43-24 | 2002 |
| invader | 5'-GAGCAAACCTCATGCCAATACAC-3' | r3A2  500-43-24 | 2003 |
| stacker | 5'-CCATTTCCAAAGGGCAG-3' | short r3A1, 3A2, 3A18  500-43-19 | 2004 |
| stacker | 5'-CCATTCCCAAGGGCAG-3' | short r3A9  500-43-20 | 2005 |
| arrestor | 5'-ACCCAGGAACGAGGCG-3' | 500-43-16 | 2006 |
| SET 2 | | | |

FIG. 47A-58

| | Sequence | ID | Label |
|---|---|---|---|
| probe | □5'-CCGTCACGCCTCGTTCCTGGGTC-NH2-3' | 2007 | 500-43-13 r3A1, 3A18 500-43-23 r3A2 500-43-24 |
| invader | | | |
| invader | | | |
| arrestor | 5'-GACCCAGGAACGAGGCG-3' | 2008 | 500-43-14 |
| SET 2 | | | |
| rat 3A's desing 3 | | | |
| probe | 5'-CCGTCACGCCTCTGAGAGCAAACCT-NH2-3' | 2009 | 500-43-29 |
| invader | 5'-AGAGCGAGTTTCATATTCAA-3' | 2010 | r3A1, 3A2 500-43-35 |
| invader | 5'-AGAGCAACTTTCATGTTCAA-3' | 2011 | r3A9 500-43-36 |
| invader | 5'-ACAGCAAGTTTCATGCTGAA-3' | 2012 | r3A18 500-43-37 |
| stacker | 5'-CATGCCAATGCAGTTCCTG-3' | 2013 | r3A1, 3A18 500-43-31 |
| stacker | 5'-CATGTCAATGCAGTTCCTG-3' | 2014 | r3A2 500-43-32 |
| stacker | 5'-CATGCCAATACAGTTCCTG-3' | 2015 | r3A9 500-43-33 |
| arrestor | 5'-AGGTTTGCTCTCCGAGGCG-3' | 2016 | 500-43-30 |
| SET 2 | | | |
| probe | □5'-CCGTCACGCCTCTGAGAGCAAACCTCA-NH2-3' | 2017 | 500-43-27 r3A1, 3A2 500-43-35 r3A9 500-43-36 r3A18 500-43-37 |
| invader | | | |
| invader | | | |
| invader | | | |
| arrestor | 5'-TGAGGTTTGCTCTCAGAGGCG-3' | 2018 | 500-43-28 |
| SET 2 | | | |
| rat 3A's designs | | | |
| probe | 5'-CCGTCACGCCTCGGAACATCTCCT-NH2-3' | 2019 | 500-43-03 |
| invader | 5'-TGTCTCCATACTGTTCAATGATGGC-3' | 2020 | r3A1, 3A2 500-43-09 |
| invader | 5'-TATCTGTATACTGGTTAATGATGGC-3' | 2021 | r3A9 500-43-10 |
| invader | 5'-TATCTCCATACTGTCTCATGAGGGC-3' | 2022 | r3A18 500-43-11 |
| s | 5'-TGAGTCTTCCACTGGTG-3' | 2023 | r3A1, 3A2 500-43-05 |
| s | 5'-TGAGCTTCCCACTGGTG-3' | 2024 | r3A9 500-43-06 |
| a | 5'-TGAGTTTGCCACTGGTG-3' | 2025 | r3A18 500-43-07 |
| SET 2 | | | |

FIG. 47A-59

| | | | |
|---|---|---|---|
| probe | 5'-CCGTCACGCCTCGGAACATCTCCTTGA-NH2-3' | 500-43-01 | 2026 |
| invader | | r3A1, 3A2  500-43-09 | |
| invader | | r3A9 500-43-10 | |
| invader | | r3A18 500-43-11 | |
| arrestor | 5'-TCAAGGAGATGTTCCGAGGCG-3' | 500-43-02 | 2027 |
| SET 2 | | | | rat 3A's design 2b

| | | | |
|---|---|---|---|
| probe | 5'-CCGTCACGCCTCGTTCCTGGG-NH2-3' | 991-39-01 | 2028 |
| invader | 5'-GAGCAAACCTCATGCCAATGCAC-3' | r3A1, 3A18  500-43-23 | 2029 |
| invader | 5'-GAGCAAACCTCATGTCAATGCAC-3' | r3A2 500-43-24 | 2030 |
| invader | 5'-GAGCAAACCTCATGCCAATACAC-3' | r3A9 500-43-25 | 2031 |
| stacker | 5'-TCCATTTCCAAAGGGCAG-3' | r3A1, 3A2, 3A18  991-39-03 | 2032 |
| stacker | 5'-TCCATTCCCAAAGGGCAG-3' | r3A9 991-39-04 | 2033 |
| arrestor | 5'-CCCAGGAACGAGGCG-3' | 991-39-02 | 2034 |
| SET 2 | | | | rat or human 1A1 shorter site 2

| | | | |
|---|---|---|---|
| probe | 5'-CCGTCACGCCTCCTGTCTCTGTGAT-HEX-3' | 1073-19-02 | 2035 |
| probe | 5'-CCGTCACGCCTCCTGTCTCTGTGAT-3' | 1073-19-01 | 2036 |
| probe | 5'-CCGTCACGCCTCCTGTCTCTGTGAT-NH2-3' | 991-12-04 | 2037 |
| invader | 5'-TCCTGACAATGCTCAATGAGGA-3' | r 1A1 500-53-11 | 2038 |
| invader | 5'-TCCTGACAGTGCTCAATCAGGA-3' | h 1A1 500-53-12 | 2039 |
| stacker | 5'-GTCCCGGATGTGGCCC-3' | rat/human 1A1  991-12-06 | 2040 |
| arrestor | 5'-ACATCACAGACAGGAGGCG-3' | 500-53-10 | 2041 |
| SET 2 | | | |

| | | | |
|---|---|---|---|
| probe | 5'-CCGTCACGCCTCCTGTCTCTGTGATG-NH2-3' | 991-12-01 | 2042 |
| invader | | r 1A1 500-53-11 | |
| invader | | h 1A1 500-53-12 | |
| stacker | 5'-TCCCGGATGTGGCCCT-3' | rat/human 1A1  991-12-03 | 2043 |
| arrestor | 5'-CATCACAGACAGGAGGCG-3' | 991-12-02 | 2044 |
| SET 2 | | | |

FIG. 47A-60 probe       5'-CCGTCACGCCTCCTGTCTGTGATGT-NH2-3'           500-53-09         2045
invader                                                   r 1A1 500-53-11   2046
invader                                                   h 1A1 500-53-12   2047
stacker     5'-GTCCCGGATGTGGCCC-3'                        rat/human 1A1 991-12-06
arrestor    5'-ATCACAGACAGGAGGGCG-3'                      991-12-05
SET 2 rat or human 1A1 site 1
probe       5'-CCGTCACGCCTCTGGCCCTTC-NH2-3'               500-53-04         2048
invader     5'-CTGTCTGTGATGTCCCGGATGA-3'                  500-53-03         2049
stacker     5'-TCAAATGTCCTGTAGTGCTC-3'                    rat 1A1 500-53-06 2050
stacker     5'-TCAAAGGTTTTGTAGTGCTC-3'                    human 1A1 500-53-07 2051
arrestor    5'-GAAGGGCCAGAGGCG-3'                         500-53-05         2052
SET 2 probe       5'-CCGTCACGCCCTCTGGCCCTTCTC-NH2-3'            500-53-01         2053
invader                                                   500-53-03
arrestor    5'-GAGAAGGGCCAGAGGCG-3'                       500-53-02         2054
SET 2

Rat/Human 1A1 site 2
probe       5'-CCGTCACGCCTCCTGTCTGTGATGT-NH2-3'           500-53-09         2055
invader     5'-TCCTGACAATGCTCAATGAGGA-3'                  r 1A1 500-53-11   2056
invader     5'-TCCTGACAGTGCTCAATCAGGA-3'                  h 1A1 500-53-12   2057
stacker     5'-CCCGGATGTGGCCCT-3'                         rat/human 1A1 500-53-14 2058
arrestor    5'-ACATCACAGACAGGAGGGCG-3'                    500-53-10         2059
SET 2 rat or human 1A2 sites
probe       5'-AACGAGGGCGCACGGACTGTTTTCTGC-HEX-3'         1073-19-04        2060
probe       5'-AACGAGGGCGCACGGACTGTTTTCTGC-3'             1073-19-03        2061
probe       5'-AACGAGGGCGCACGGACTGTTTTCTGC-NH2-3'         500-53-15         2062
invader     5'-CTTGTTGAAGTCTTGATAGTGTTCCTC-3'             rat 1A2 500-53-17 2063
invader     5'-CTTGTCAAAGTCCTGATAGTGCTCCTC-3'             human 1A2 500-53-18 2064
arrestor    5'-GCAGAAAACAGTCCGTGCGC-3'                    500-53-16         2065
SET 1

FIG. 47A-61 shorter h2C19 design site 3

| | | |
|---|---|---|
| probe | 5'-AACGAGGCGCACGATGTCCATCG-NH2-3' | 971-48-01 | 2066 |
| invader | 5'-GCAATCAATAAAGTCCCGAGGGTTGTTC-3' | 971-26-11 | 2067 |
| stacker | 5'-ATTCTTGGTGTTCTTTACTTTCTC-3' | 971-48-03 | 2068 |
| arrestor | 5'-CGATGGACATCGTGCGC-3' | 971-48-02 | 2069 |

SET 1

|  | Sequence | Oligo Number | Secondary Cassette | Comments | |
|---|---|---|---|---|---|
| probe | cagtcacgtctctcctgtgacctgt-NH2 | 511-46-01 | MO4-1/MO4-2/MO4-3 | 3' amine | 2116 |
| arrestor | acgaggtcacaggaggagc | 511-46-02 |  | All 2'-Ome + 3' amine arrestor for 511-46-01 | 2117 |
| probe | cagtcacgctctcctgtgacct-NH2 | 511-69-01 | MO4-1/MO4-2/MO4-3 | 3' amine | 2118 |
| arrestor | gaggtcacaggaggagc | 511-69-02 |  | All 2'-Ome + 3' amine arrestor for 511-69-01 | 2119 |
| probe | cagtcacgctctcctgtgacc-NH2 | 781-68-01 | MO4-1/MO4-2/MO4-3 | 3' amine | 2120 |
| stacker | tcggttcaaaatgccgatgatctctctca | 781-68-02 |  | All 2'Ome stacker for 781-68-01 | 2121 |
| arrestor | ggtcacaggaggagcg | 781-68-03 |  | All 2'-Ome arrestor for 781-68-01 | 2122 |
| probe | cagtcacgctctctgtgac-NH2 | 781-69-01 | MO4-1/MO4-2/MO4-3 | 3' amine | 2123 |
| stacker | ctcggttcaaaatgccgatgatctctctca | 781-69-02 |  | All 2'Ome stacker for 781-69-01 | 2124 |
| arrestor | gtcacaggaggagcg | 781-69-03 |  | All 2'-Ome arrestor for 781-69-01 | 2125 |
| invader | acatccatctcgtgcatggcgtccctta | 511-47-01 |  |  | 2126 |
| probe | cagtcagtctctccttctct-NH2 | 511-17-01 | MO2 | 3' amine | 2127 |
| arrestor | aggagaaggagagacg | 511-17-02 |  | All 2'-Ome + 3' amine arrestor for 511-17-01 | 2128 |
| invader | gcacatccatctccgctcatggcga | 511-18-01 |  |  | 2129 |
| probe | ccgccgagctcactcgtgacc-NH2 | 781-83-01 | TT-1/TT-2 | 3' amine | 2130 |
| arrestor | ggtcacgagtgatc | 781-83-02 |  | All 2' Ome arrestor for 781-83-01 | 2131 |
| probe | cgtcacgctctcdggacc-NH2 | 781-82-01 | MO4-1/MO4-2/MO4-3 | 3' amine | 2132 |
| invader | ccgtgcatgcgtccctca | 781-82-02 |  |  | 2133 |
| arrestor | ggtcacaggagagcg | 781-82-03 |  | All 2' Ome arrestor for 781-82-01 | 2134 |
| probe | cgtcacgctctccgtgacc-NH2 | 781-84-01 | MO4-1/MO4-2/MO4-3 | 3' amine | 2135 |
| invader | cgtcaggcgtccttca | 781-84-02 |  |  | 2136 |
| arrestor | ggtcacgggaggcg | 781-84-03 |  | All 2' Ome arrestor for 781-84-01 | 2137 |

Mouse IL-2

|  | Sequence | Oligo Number | Secondary Cassette | Comments | |
|---|---|---|---|---|---|
| probe | cagtcacgtctcttagttacaacagttactct-NH2 | 511-19-01 | MO2 | 3' amine | 2138 |
| arrestor | agagtaaactgttgtaaaactaaagagacg | 511-19-02 |  | Alt 2'-Ome + 3' amine arrestor for 511-19-01 | 2139 |
| invader | gcactcaaatgtgttgtgagagccca | 511-20-01 |  |  | 2140 |

Mouse IFN-γ

| Oligo Type | Sequence | Oligo Number | Secondary Cassette | Comments | |
|---|---|---|---|---|---|
| probe | cagtcacgtctctccttttgccagttcc-NH2 | 511-24-01 | MO2 | 3' amine | 2141 |
| arrestor | ggaactggcaaaaggaggagacg | 511-24-02 |  | All 2'-Ome + 3' amine arrestor for 511-24-01 | 2142 |
| probe | cagtcacgtctctccttttgccagttc-NH2 | 511-23-01 | MO2 | 3' amine | 2143 |
| arrestor | gaactggcaaaaggagagcg | 511-23-02 |  | All 2'-Ome + 3' amine arrestor for 511-23-01 | 2144 |
| probe | cagtcacgtctctccttgccagtt-NH2 | 511-21-01 | MO2 | 3' amine | 2145 |
| arrestor | aactggcaaaaggagagcg | 511-21-02 |  | All 2'-Ome + 3' amine arrestor for 511-21-01 | 2146 |
| invader | gctctgcaggatttcatgtcaccaa | 511-22-01 |  |  | 2147 |

Human TNF-α

| Oligo Type | Sequence | Oligo Number | Secondary Cassette | Comments | |
|---|---|---|---|---|---|
| probe | ccgccggagctcacdcgadcgacctg-NH2 | 511-77-01 | TT-1/TT-2 | 3' amine (based on 685-27-01-1 base shorter) | 2148 |
| arrestor | caggcagtcagagtgatcgg | 511-77-02 |  | All 2'-Ome + 3' amine arrestor for 511-77-01 | 2149 |
| probe | ccgccggagctcacdcgadcgacdcct-NH2 | 511-78-01 | TT-1/TT-2 | 3' amine (based on 685-27-01-2 bases shorter) | 2150 |
| arrestor | aggcagtcagcgtgatcdgg | 511-78-02 |  | All 2'-Ome + 3' amine arrestor for 511-78-01 | 2151 |
| invader | ctt gtc act cgg ggt tcg aga aga tga a | 685-28-01 |  |  | 2152 |

FIG. 47A-64

| Human IL-1β Oligo Type | Sequence | Oligo Number | Secondary Cassette | Comments | |
|---|---|---|---|---|---|
| probe | gccgtcacgcctccatgtttagggcc-NH2 | 511-79-01 | MO4-1/MO4-2/MO4-3 | 3' amine (based on 685-21-01) | 2153 |
| arrestor | ggccctaaacagatgagggcgt | 511-80-01 | | All 2'-Ome + 3' amine arrestor for 511-79-01 | 2154 |
| arrestor | ggcctaaacagatgagggcgtga | 511-80-02 | | All 2'-Ome + 3' amine arrestor for 511-79-01 | 2155 |
| invader | cagtcctggaaggagcacta | 685-23-01 | | | 2156 |

| Human IL-6 Oligo Type | Sequence | Oligo Number | Secondary Cassette | Comments | |
|---|---|---|---|---|---|
| probe | gccgtcacgcctctcctcattgaatcct-NH2 | 511-81-01 | MO4-1/MO4-2/MO4-3 | 3' amine (based on 685-16-01) | 2157 |
| arrestor | aggattcaatgaggagagaggcgt | 511-82-01 | | All 2'-Ome + 3' amine arrestor for 511-81-01 | 2158 |
| arrestor | aggattcaatgaggagagaggcgt | 511-82-02 | | All 2'-Ome + 3' amine arrestor for 511-81-01 | 2159 |
| probe | cgtcacgcctctcctcattgaatcct-NH2 | 781-27-01 | MO4-1/MO4-2/MO4-3 | 3' amine (511-81-01 with new arm) | 2160 |
| arrestor | aggattcaatgaggagagggcg | 781-27-02 | | All 2'-Ome + 3' amine arrestor for 781-27-01 | 2161 |
| probe | gccgtcacgcctctcctcattgaatcc-NH2 | 511-83-01 | | 3' amine (based on 685-16-01) | 2162 |
| arrestor | ggattcaatgaggagagggcgtga | 511-84-01 | | All 2'-Ome + 3' amine arrestor for 511-81-01 | 2163 |
| arrestor | ggattcaatgaggagagggcgt | 511-84-02 | | All 2'-Ome + 3' amine arrestor for 511-81-01 | 2164 |
| probe | cgtcacgcctctcctcattgaatcc-NC | 781-28-01 | MO4-1/MO4-2/MO4-3 | 3' amine (511-83-01 with new arm) | 2165 |
| arrestor | ggattcaatgaggagagggcg | 781-28-02 | | All 2'-Ome + 3' amine arrestor for 781-28-01 | 2166 |
| probe | cgtcacgcctctcctcattgaatc-NH2 | 781-29-01 | MO4-1/MO4-2/MO4-3 | 3' amine (1 base shorter than 781-28-01) | 2167 |
| arrestor | gattcaatgaggagagggcg | 781-29-02 | | All 2'-Ome + 3' amine arrestor for 781-29-01 | 2168 |
| probe | cgcgagatcacctccatgaatc-NH2 | 781-30-01 | TT-1/TT-2 | 3' amine (781-29-01 with new arm) | 2169 |
| arrestor | gattcaatgaggagagtgatctc | 781-30-02 | | All 2'-Ome + 3' amine arrestor for 781-30-01 | 2170 |
| invader | cca aaa gtc cag tga tga ttt tca cca ggc aag a | 685-18-01 | | | 2171 |

Secondary Cassettes

| | | | | |
|---|---|---|---|---|
| SRT | cggaggaagcagttggtgcgcctgtttaaNH2 | 277-68-05 | FV-1 | 2172 |
| FRET probe | Fcaac(Cy3)tgcttcctccg | 187-46-01 | | 2173 |
| SRT | ccaggaagcaagtggtgcgcctgttt | 996-29-01 | FV-2 | 2174 |
| FRET probe | Fcac(Z21)tgcttcgtgg | 767-29-02 | | 2175 |
| SRT | cggaagaagcagttggaggcgtgaacggtNH2 | 641-60-03 | MO4-1 | 2176 |
| FRET probe | Fcaac(Cy3)tgcttcctccg | 187-46-01 | | 2177 |
| SRT | cggaagaagcagttggaggcgtgacgacNH2 | 562-83-01 | MO4-2 | 2178 |
| FRET probe | Fcaac(Cy3)tgcttcctccg | 187-46-01 | | 2179 |
| SRT | ccaggaagcaagttggaggcgtgacgau | 996-29-02 | MO4-3 | 2180 |
| FRET probe | Fcac(Z21)tgcttcgtgg | 767-29-02 | | 2181 |
| SRT | cggaggaagcagttggtgatccgcgcagcNH2 | 562-82-01 | TT-1 | 2182 |
| FRET probe | Fcaac(Cy3)tgcttcctccg | 187-46-01 | | 2183 |
| SRT | cggaagaagcagttgtgatccgcaggNH2 | 685-56-01 | TT-2 | 2184 |
| FRET probe | Fcaac(Cy3)tgcttcctccg | 187-46-01 | | 2185 |
| SRT | gctacggaatgaaggagaggtgactgtaNH2 | 491-68-02 | MO2 | 2186 |
| FRET probe | Fcttc(Cy3)tctcagtagc | 491-68-01 | | 2187 |

FIG. 47A-65

| | | | |
|---|---|---|---|
| SRT | ccg agg aag cgg ttg cgt acg act ggt taa-NH2 | 458-35-03 | MISC-1 |
| FRET probe | Fcaaac(Cy3)gcttcctccg | 187-46-01 | |
| SRT | cgg agg aag cgg ttg gtg cgg gtg gtt gga-PO3 | 441-31-02 | MISC-2 |
| FRET probe | Fcaaac(Cy3)gcttcctccg | 187-46-01 | |

Oligo sequence descriptions: 5' to 3' direction, 2'-Ome nts are bolded and underlined, internal modifications defined in ( )

FRET Oligo/SRT Combinations

| | FRET Oligo | SRT |
|---|---|---|
| Set 1 | 187-46-01 | 641-60-02 |
| Set 2 | 187-46-01 | 690-82-03 |
| Set 3 | 307-70-02 | 339-50-03 |
| Set 4 | 303-18-05 | 343-63-07 |
| Set 5 | 303-18-05 | 343-25-01 |
| Set 6 | 187-46-01 | 649-10-01 |
| Set 7 | 744-80-03 | 277-068-05N |
| Set 8 | 187-46-01 | 833-18-07 |
| Set 9 | 767-28-03 | 777-71-10 |
| Set 10 | 767-29-02 | 996-29-01 |
| Set 11 | 1067-20-01 | 986-29-01 |
| Set 12 | 307-70-02 | 307-70-04 |
| Set 13 | 491-01-01 | 491-02-04 |
| Set 14 | 187-46-01 | 562-84-01 |

FRET Oligos

| Oligo # | Oligo Sequence | SEQ ID NO |
|---|---|---|
| 187-46-01 | Fam-CAAC(CY3)GCTTCCTCCG | 2192 |
| 307-70-02 | Fam-ATTC(CY3)TCTCAGAC-NH2 | 2193 |
| 303-18-05 | Fam-TAAC(CY3)GCTTCCTCCG | 2194 |
| 744-80-03 | Fam-CAA(Daboyl)TGCTTCCTCCG | 2195 |
| 767-28-03 | Red Dye-CTC(Z-2-21)TTCTCAGTGCG | 2196 |
| 767-29-02 | Fam-CAC(Z-2-21)TGCTTCGTGG | 2197 |
| 1067-20-01 | Fam-CAC(Z-2-28)TGCTTCGTGG | 2198 |
| 491-01-01 | Fam-CTTC(CY3)TCTCAGAC | 2199 |

SRT

| Oligo # | Oligo Sequence | SEQ ID NO |
|---|---|---|
| 641-60-02 | CGGAGGAAGCAGTTGGAGGCGTGACGGT-NH2 | 2200 |
| 690-82-03 | CGGAGGAAGCAGTTGTGGCGGTGACGGTT | 2201 |
| 339-50-03 | CAGTCTGAGATGAATGAGACGAGAGAGT-NH2 | 2202 |
| 343-63-07 | CGGAGGAAGCCGTTAGTCTGTCACGTCAT-NH2 | 2203 |
| 343-25-01 | CGGAGGAAGCCGTTAGTCTGCGCCACGTCAT-NH2 | 2204 |
| 649-10-01 | CGGAAGAAGCAGTTGGTGCGCCCTCGTTAA-NH2 | 2205 |
| 277-068-05N | CGGAGGAAGCAGTTGTGCGCCCTCGTTAA-NH2 | 2206 |
| 833-18-07 | CGGAGGAAGCAGTTGCGGGCGTGCGGCCT-NH2 | 2207 |
| 777-71-10 | GCGCAGTGAGAATGAGGAGGCGTGACGGU-NH2 | 2208 |
| 996-29-01 | CCAGGAAGCAAGTGGTGCGGCTCGUUU | 2209 |
| 307-70-04 | CAGTCTGAGATGAATGATACGCCAGG-NH2 | 2210 |
| 491-02-04 | AGTCTGAGATGAAGGAGACGTGACTGTGG-NH2 | 2211 |
| 562-84-01 | CGGAGGAAGCGGTTGGTGATCTCGGCG-NH2 | 2212 |

FIG. 47A-67

| Oligo Type | Oligo # | Oligo Sequence | Notes | Position | SEQ ID NO |
|---|---|---|---|---|---|
| Human IL-2 | | | | | |
| Probe | 196-56-01 | TCTGTGGCGTATCCTTCTTGGGCATGTAA | | Splice Junction 2 | 2213 |
| Probe | 196-56-02 | GTGGCGTATCCTTCTTGGGCATGTAA | | | 2214 |
| Probe | 196-56-03 | GCGTATCCTTCTTGGGCATGTAA | | | 2215 |
| Invader | 128-93-02 | GAAGATGTTTCAGTTCGTGTG(ddC) | ddC = dideoxy C | | 2216 |
| Capture Oligo | 145-030-05 | AAAGATACGGCCACAGAACACG(BIOTIN-dA)TT | | | 2217 |
| Probe | 315-28-01 | TGGCGTATCTTAATTCCATTCAAAAT | | | 2218 |
| Probe | 315-28-02 | TGGGAGTTTGGGATTCTTGTAATTAA | | | 2219 |
| Capture Oligo | 195-023-01 | AAAGATACGGCCACAGC(BIOTIN-dT)C | | | 2220 |
| Probe | 315-29-01 | TGGCGTATCTAATTATTAATTCCATTC | | Splice Junction 1 | 2221 |
| Invader | 315-29-02 | ATCCTGGTGAGTTTGGGATTCTTGA | | | 2222 |
| Capture Oligo | 195-023-01 | AAAGATACGGCCACAGC(BIOTIN-dT)C | | Splice Junction 1 | 2223 |
| Probe | 315-29-03 | TGGCGTATCTTCCATTCAAAATCATC | | | 2224 |
| Invader | 315-29-04 | GTTTGGGATTCTTGTAATTATTAAA | | | 2225 |
| Capture Oligo | 195-023-01 | AAAGATACGGCCACAGC(BIOTIN-dT)C | | Splice Junction 2 | 2226 |
| Probe | 315-30-01 | GTGGCGTATCCTTCTTGGGCAT | | | 2227 |
| Invader | 315-30-02 | GAAGATGTTTCAGTTCTGTGC | | | 2228 |
| Capture Oligo | 195-023-01 | AAAGATACGGCCACAGC(BIOTIN-dT)C | | | 2229 |
| Human b-actin | | | | | |
| Probe | 315-26-01 | TGGCGTATCTCTGGGTCATCTTC | | Splice Junction 3 | 2230 |
| Invader | 315-26-02 | GGGTGTTGAAGGTCTCAAACATGAA | | | 2231 |
| Capture Oligo | 195-023-01 | AAAGATACGGCCACAGC(BIOTIN-dT)C | | | 2232 |
| Probe | 315-27-01 | TGGCGTATCTCTTGATCTTCATTGT | | Splice Junction 5 | 2233 |
| Invader | 315-27-02 | ACTTGCGCTCAGGAGGAGCAATGAA | | | 2234 |
| Capture Oligo | 195-023-01 | AAAGATACGGCCACAGC(BIOTIN-dT)C | | | 2235 |
| Probe | 315-91-01 | TGGCGTATCTGATCTGGGTCATCT | | Splice Junction 3 | 2236 |
| Invader | 315-91-02 | TGGCTGGGGTGTTGAAGGTCTCAAACAA | | | 2237 |
| Capture Oligo | 195-023-01 | AAAGATACGGCCACAGC(BIOTIN-dT)C | | | 2238 |
| Probe | 315-92-01 | ACCGTATCTGCCCAGGAGGA | | Splice Junction 4 | 2239 |
| Invader | 315-92-02 | AGTTTCGTGGATGCCACAGGAGACCAA | | | 2240 |
| Capture Oligo | 315-92-03 | AGTTTCGTGGATGCTACAGGAGACCAA | | | 2241 |
| Capture Oligo | 195-023-01 | AAAGATACGGCCACAGC(BIOTIN-dT)C | | | 2242 |
| Probe | 340-32-01 | TGGGGTATCTCTCAAACATGATCT | | Splice Junction 3 | 2243 |
| Invader | 340-32-02 | ACGTACATGCGCTGGGGTGTTGAAGGA | | | 2244 |
| Capture Oligo | 195-023-01 | AAAGATACGGCCACAGC(BIOTIN-dT)C | | | 2245 |
| Probe | 340-33-01 | TGGCGTATCTGATCTGGGTCATC | | Splice Junction 3 | 2246 |
| Invader | 340-33-02 | TGCCTGGGGTGTTGAAGGTCTCAAACAA | | | 2247 |
| Capture Oligo | 195-023-01 | AAAGATACGGCCACAGC(BIOTIN-dT)C | | | 2248 |
| Probe | 740-01-01 | CCGTCACGCCTCCGCCTTGGGGTTC | | Splice Junction 3 | 2249 |
| Invader | 740-01-02 | TCTGGGTCATCTTCTCGCGGTTGA | | | 2250 |
| Arrestor | 740-01-03 | GAACCCCAAGGCGGAGGCGT | | | 2251 |
| Secondary Cassette | | Set 1 | | | |
| Probe | 740-01-08 | CCGTCACCGCCATGGGTCATCTTCT | | Splice Junction 3 | 2252 |
| Stacker | 740-01-04 | CGCGGTTGGCCTTGGGGTT | | | 2253 |
| Invader | 740-01-06 | CTGGGGTGTTGAAGGTCTCAAACATGATCC | | | 2254 |
| Arrestor | 740-01-09 | AGAAGATGACCCATGGCGG | | | 2255 |
| Secondary Cassette | | Set 2 | | | |
| Mouse GAPDH | | | | | |

FIG. 47A-68

| Type | ID | Sequence | Note | # |
|---|---|---|---|---|
| Probe | 425-59-01 | Fl-CTCTCTCGTCTCTCCTGGAAGA | Fl = Fluorescien | 2256 |
| Invader | 425-59-02 | ATTTGATGTTAGTGGGTCTCGCA | | 2257 |
| Probe | 425-60-01 | Fl-CTCTCTCGTCTCTGCTGACAATC | Fl = Fluorescien | 2258 |
| Invader | 425-60-02 | GCAGTTGGTGGTGCAGGATGCATA | | 2259 |
| Probe | 425-61-01 | Fl-CTCTCTCGTCTCTACCAGGAAATG | Fl = Fluorescien | 2260 |
| Invader | 425-61-02 | GCTGTAGCCGTATTCATTGTCAA | | 2261 |
| Probe | 425-80-01 | Fl-CTCTCTCGTCTCTCCTGGAAG | | 2262 |
| Invader | 425-80-02 | CATTTGATGTTAGTGGGGTCTCGA | | 2263 |
| Probe | 425-87-01 | CTCTCTCGTCTCTCCTGGAAGA | Same as 425-59-01 without Fluorescien | 2264 |
| Arrestor | 425-59-02 | ATTTGATGTTAGTGGGGTCTCGCA | | 2265 |
| Secondary Cassette | 425-87-04 | TCTTCCAGGAGAGACG | | 2266 |
| | | Set 3 | | |
| Probe | 425-87-02 | CTCTCTCGTCTCTCCTGGAAG | Same as 425-80-01 without Fluorescien | 2267 |
| Invader | 425-80-02 | CATTTGATGTTAGTGGGGTCTCGA | | 2268 |
| Arrestor | 425-87-05 | CTTCCAGGAGGAGACG | | 2269 |
| Secondary Cassette | | Set 3 | | |
| Probe | 425-87-03 | CTCTCTCGTCTCTACCAGGAAATG | Same as 425-61-01 without Fluorescien | 2270 |
| Invader | 425-61-02 | GCTGTAGCCGTATTCATTGTCAA | | 2271 |
| Arrestor | 425-87-06 | CATTTCCTGGTAGAGACG | | 2272 |
| Secondary Cassette | | Set 3 | | |
| Probe | 453-23-01 | ATGACGTGACAGACCTCCTGGAAGAT | | 2273 |
| Invader | 453-23-03 | ATGACGTGACAGACCTCCTGGAAGATG | | 2274 |
| Probe | 425-80-02 | CATTTGATGTTAGTGGGGTCTCGA | | 2275 |
| Arrestor | 453-23-04 | GATCTTCCAGGAGGTCTGT-NH2 | | 2276 |
| Secondary Cassette | | Set 4 | | |
| Probe | 453-23-02 | ATGACGTGGCAGACCTCCTGGAAGAT | Splice Junction 4 | 2277 |
| Arrestor | 425-80-02 | CATTTGATGTTAGTGGGGTCTCGA | | 2278 |
| Secondary Cassette | 453-23-05 | ATCTTCCAGGAGGTCTGC-NH2 | | 2279 |
| | | Set 5 | | |
| Probe | 435-67-04 | CAGTCACGTCTCTTCAGGTTTTG | | 2280 |
| Invader | 395-05-07 | AGGCAGCTCTCAGGTCAGGTGTGA | | 2281 |
| FRET Probe - Secondary Reaction | 524-51-01 | Fl-CTTC(Cy3)TCTCAGTAGCG | | 2282 |
| Secondary Reaction Template | 524-51-03 | CGCTACTGAGATGAAGGAGACGTGACTGTA-NH2 | | 2283 |
| Secondary Reaction Template | 524-51-04 | CGCTAATGAGATGAAGGAGACGTGACTGTA-NH2 | | 2284 |
| Probe | 435-67-04 | CAGTCACGTCTCTTCAGGTTTTG | | 2285 |
| Invader | 395-05-07 | AGGCAGCTCTCAGGTCAGGTGTGA | | 2286 |
| FRET Probe - Secondary Reaction | 524-51-02 | Fl-CTTC(Cy3)TCTCAGTAGCCA | | 2287 |
| Secondary Reaction Template | 524-51-05 | TCGCTACTGAGATGAAGGAGACGTGACTGTA-NH2 | | 2288 |
| Secondary Reaction Template | 524-51-06 | TCGCTAATGAGATGAAGGAGACGTGACTGTA-NH2 | | 2289 |
| Human Ubiquitin | | | | |
| Probe | 796-72-01 | AACGAGGCGCACCTTTACATTTTCTATCC | | 2290 |
| Invader | 428-81-02 | CCTTCCTTATCCTGGATCTTGGCA | 119 | 2291 |
| Arrestor | 796-72-02 | GGATACGATAGAAAATGTAAAGGTGCGC | | 2292 |
| Secondary Cassette | | Set 6 | | |
| Probe | 796-72-03 | AACGAGGCGCACCTTTACATTTTCTATCGTATC | | 2293 |
| Invader | 428-81-02 | CCTTCCTTATCCTGGATCTTGGCA | | 2294 |
| Arrestor | 796-72-04 | GATACGATAGAAAATGTAAAGGTGCGC | | 2295 |
| Secondary Cassette | | Set 6 | | |
| Probe | 820-35-01 | AACGAGGCGCACCTTTACATTTTCTATCG | | 2296 |
| Probe | 820-35-02 | AACGAGGCGCACCTTTACATTTTCTATCGT | | 2297 |

FIG. 47A-69

| | | | | |
|---|---|---|---|---|
| Invader | 428-81-02 | CCTTCCTTATCCTGGATCTTGGCA | | 2298 |
| Arrestor | 820-35-03 | ACGATAGAAAATGTAAAGTGCGC | | 2299 |
| Secondary Cassette | | Set 7 | | |
| Probe | 820-88-01 | AACGAGGGGCACCTTTACATTTTCTATCGT-NH2 | Same as 820-35-02 with 3' Amine | 2300 |
| Probe | 820-88-02 | AACGAGGGGCACCTTTACATTTTCTATCGTU | Same as 820-35-02 with O-Me U for Blocking | 2301 |
| Probe | 820-88-03 | AACGAGGGGCACCTTTACATTTTCTATCGTG | Same as 820-35-02 with O-Me G for Blocking | 2302 |
| Probe | 820-88-04 | AACGAGGGCGCACCTTTACATTTTCTATCGTT | Same as 820-35-02 with T for Blocking. The T is a mismatch against the RNA sequence. | 2303 |
| Invader | 428-81-02 | CCTTCCTTATCCTGGATCTTGGCA | | 2304 |
| Arrestor | 820-35-03 | ACGATAGAAAATGTAAAGTGCGC | | 2305 |
| Secondary Cassette | | Set 7 | | |
| Probe | 847-65-01 | GCCGCACGCCGCTTTACATTTTCTATCGT | | 2306 |
| Invader | 428-81-02 | CCTTCCTTATCCTGGATCTTGGCA | | 2307 |
| Arrestor | 847-65-02 | ACGATAGAAAATGTAAAGCGGCG | | 2308 |
| Secondary Cassette | 847-65-03 | ACGATAGAAAATGTAAAGCGGCGT | | 2309 |
| | | Set 8 | | |
| Probe | 936-61-01 | AACGAGGGCGCACCTTTACATTTTCTATCGTATCCG | Same as 428-87-01 without Biotin blocking group | 2310 |
| Invader | 428-81-02 | CCTTCCTTATCCTGGATCTTGGCA | | 2311 |
| Arrestor | 936-61-02 | CGGATACGATAGAAAATGTAAAGGTGCGC | Same as 428-87-03 without Biotin blocking group | 2312 |
| Secondary Cassette | | Set 7 | | |

Monocyte Chemotactic Protein 1 (MCP-1)

| | | | | |
|---|---|---|---|---|
| Probe | 820-89-01 | CCGTCAGTGCCTCCTTCGGAGTTTGGG | | 2313 |
| Invader | 685-76-01 | GGGTTGTGCGAGTGAGTGTTCAAGTA | Same as 720-92-01 without the amine | 2314 |
| Arrestor | 820-89-02 | CCCAAACTCCGAAGGAGGCG | | 2315 |
| Secondary Cassette | | Set 9 | | |

MAGE-3

| | | | | |
|---|---|---|---|---|
| Probe | 1001-01-01 | FI-TTTTCTGGAAGCTTTGCT | | 2316 |
| Invader | 871-18-03 | CGATGCCAAGACCACGTGCAAGGAAG | Same analyte specific Region as 871-18-02. | 2317 |
| Stacker | 871-18-01 | GAAGATCACAGGAAAGAAATAC | | 2318 |
| Stacker | 1138-50-01 | GCAGCTTCTTGGGA | | 2319 |
| Stacker | 1138-50-02 | AACGAGGCGCACGTTGGGTGA | | 2320 |
| Stacker | 1138-50-03 | GCAGCTTCTTGGGACT | | 2321 |
| Probe | 1138-50-04 | AACGAGGCGCACGTTGGGTGAG | | 2322 |
| Probe | 1138-50-05 | CTCCAGGTAGTTTTCCTGCACGAAATC | | 2323 |
| Invader | 1138-50-06 | CTCACCCAACGTGCGC | | 2324 |
| Arrestor | | Set 10 | | |
| Secondary Cassette | | | | |
| Stacker | 1138-51-01 | AGCTTCTTGGGATC | | 2325 |
| Stacker | 1138-51-02 | AACGAGGGCGCACTTGGGTGAGC | | 2326 |
| Stacker | 1138-51-03 | GCTTCTTGGGATCC | | 2327 |
| Probe | 1138-51-04 | AACGAGGCGCACTTGGGTGACCA | | 2328 |
| Probe | 1138-51-05 | CAGGTAGTTTTCCTGCACGAAATGA | | 2329 |
| Invader | 1138-51-06 | TGCTCACCCAAGTGCGC | | 2330 |
| Arrestor | | Set 11 | | |
| Secondary Cassette | | | | |
| Stacker | 1138-67-01 | TGCAGGATCACTGCC | | 2331 |
| Probe | 1138-67-02 | AACGAGGCGCACCACCAATTCATAACA | | 2332 |
| Probe | 1138-67-03 | GGCCCTTGGACCCCAA | | 2333 |
| Invader | 1138-67-04 | TGTTATGAATTGGTGGTGCGC | | 2334 |
| Arrestor | | | | |
| Secondary Cassette | | | | |
| Stacker | 1138-67-05 | CATGCAGGATCACTGC | | 2335 |

FIG. 47A-70

| Type | ID | Sequence | Notes | SEQ ID |
|---|---|---|---|---|
| Probe | 1138-67-06 | AACGAGGCGCACCACACCAATTCATAA | | 2336 |
| Invader | 1138-67-07 | AGGGCCCTTGGACCCA | | 2337 |
| Arrestor | 1138-67-08 | TTATGAATTGGTGTGGTGCGGC | | 2338 |
| Secondary Cassette | | Set 11 | | |
| Human Oncostatin M | | | | |
| Probe | 339-30-02 | CCTGGCGTATCTAGGGCTCCA | | 2339 |
| Invader | 264-42-03 | GTGTTCAGGTTTTGGAGGCGGATAA | | 2340 |
| Arrestor | 374-32-01 | CTTGGAGCCCTAGATAC-NH2 | | 2341 |
| Arrestor | 374-32-02 | CTTGGAGCCCTAGATACG-NH2 | | 2342 |
| Arrestor | 374-32-03 | CTTGGAGCCCTAGATACGC-NH2 | | 2343 |
| Secondary Cassette | | Set 12 | | |
| Probe | 524-39-01 | CAGTCACGTCTCTTCAGGTTTTG-NH2 | | 2344 |
| Invader | 395-05-07 | AGGCAGCTCTCAGGTCAGGTGTGA | | 2345 |
| Stacker | 435-40-02 | GAGGCGGATATAGGGCTCCA | Same as 435-67-04 with 3' Amine | 2346 |
| Arrestor | 369-47-07 | CAAAACTGAAGAGACG-NH2 | | 2347 |
| Secondary Cassette | | Set 13 | | |
| Probe | 1088-74-01 | AACGAGGCGCACCCTCTGTGTG | | 2348 |
| Arrestor | 1088-74-02 | CACACAGAGGGTGCGC | | 2349 |
| Probe | 1088-74-03 | AACGAGGCGCACCCTCTGTGTG-NH2 | | 2350 |
| Probe | 1088-74-04 | AACGAGGCGCACCCTCTGTGTG-HEX | HEX = Hexanediol | 2351 |
| Invader | 603-75-03 | GCAAGGACCAGACTGAGCAGCGTA | | 2352 |
| Stacker | 752-01-05 | AGCAGTACCCCCATG | | 2353 |
| Arrestor | 641-82-04 | CACACAGAGGGAGCG-NH2 | | 2354 |
| Secondary Cassette | | Set 10 | | |
| Probe | 1138-49-02 | AACGAGGCGCACCTTCTGGAG-NH2 | | 2355 |
| Stacker | 1138-49-01 | CTTGCCAAGGAG | | 2356 |
| Invader | 1138-49-03 | GTCCTGCATGAGATCTCTCTGA | | 2357 |
| Arrestor | 1138-49-04 | CTCCAGAAGGTGCGC | | 2358 |
| Secondary Cassette | | Set 11 | | |
| Probe | 1138-49-06 | AACGAGGCGCACTCTGCTTCT-NH2 | | 2359 |
| Stacker | 1138-49-05 | GGAGCTGGCCAA | | 2360 |
| Invader | 1138-49-07 | TGGTGTCCTGCATGAGATCTGA | | 2361 |
| Arrestor | 1138-49-08 | TCGAAGCAGAGTGCGC | | 2362 |
| Secondary Cassette | | Set 11 | | |
| Probe | 1138-49-10 | AACGAGGCGCACCATGAGATCT-NH2 | | 2363 |
| Stacker | 1138-49-09 | GTCTGCTTCTTGA | | 2364 |
| Invader | 1138-49-11 | GAGTCTGCTGGTGTCCCTGA | | 2365 |
| Arrestor | 1138-49-12 | AGATCTCATGGTGCGC | | 2366 |
| Secondary Cassette | | Set 11 | | |
| Stacker | 1163-01-01 | TGGCCAAGGAGCA | | 2367 |
| Probe | 1163-01-02 | AACGAGGCGCACTTCTGGAGC-NH2 | | 2368 |
| Invader | 1163-01-03 | TCCTGCATGAGATCTCTGTCTGA | | 2369 |
| Arrestor | 1163-01-04 | GCTCCAGAAGTGCGC | | 2370 |
| Secondary Cassette | | Set 11 | | |
| Stacker | 1163-01-05 | GGCCAAGGAGGAC | | 2371 |
| Probe | 1163-01-06 | AACGAGGCGCACTCTGGAGCT-NH2 | | 2372 |
| Invader | 1163-01-07 | CCTGCATGAGATCTGTCTGCTA | | 2373 |
| Arrestor | 1163-01-08 | AGCTCCAGAGTGCGC | | 2374 |
| Secondary Cassette | | Set 11 | | |
| Stacker | 1163-01-09 | GCCAAGGAGGACG | | 2375 |
| Probe | 1163-01-10 | AACGAGGCGCACCTGGAGCTC-NH2 | | 2376 |

FIG. 47A-71

| | | | |
|---|---|---|---|
| Invader | 1163-01-11 | CCTGCATGAGATCTGTCTGCTTA | 2377 |
| Arrestor | 1163-01-12 | GAGCTCCAGGTGCGC | 2378 |
| Secondary Cassette | | Set 11 | |
| | | | |
| 84h6r | | | |
| Probe | 688-51-01 | CGCCGAGATCACGCCAACGACGGTCT | 2379 |
| Invader | 688-51-02 | AGCCCTTGAGTTTAATAACTTCATAGGCACTA | 2380 |
| Arrestor | 688-51-03 | AGACCGTCGTTGGCGTGATC | 2381 |
| Secondary Cassette | | Set 14 | |
| Probe | 688-51-04 | CGCCGAGATCACCTCAACACCATAAAAGCCA | 2382 |
| Invader | 688-51-05 | CGGGAGACTGAGGAATACGTCACCACCA | 2383 |
| Arrestor | 688-51-06 | TGGCTTTTATGGTGTTGAGGTGATC | 2384 |
| Secondary Cassette | | Set 14 | |
| | | | |
| MSH2 | | | |
| Probe | 690-32-02 | CCGTCACGCCTCCGAACTGCCCTAG | 2385 |
| Invader | 690-32-04 | GTATAATAGTCCCGACGATCAAAGAGGC | 2386 |
| Stacker | 709-52-01 | GGTCCTTGGGYAGGG | 2387 |
| Arrestor | 690-32-05 | GCGGAGGCTTGACGGGATC | 2388 |
| Secondary Cassette | | Set 1 | |

FIG. 47A-72 bold indicates 2' O methyl base

ELISA Format Kits
Leukocyte-associated molecule-1 alpha subunit, human (h-LFA1)
G4731 Probe Set

| | | SEQ ID NO |
|---|---|---|
| p | 5'-CTCTCTCGTCTCCAGGGCGTCGTCGG-PO4-3' | 2389 |
| l | 5'-CTGTCACACACGTCGGTGCTGA-3' | 2390 |
| c | 5'-AAAAGGAGACGAGAGAGTG-3' | 2391 | for the remainder of the oligo sets on this list, the fret/target secondary sets are one of the following 11:

FRET/TARGET SETS

| | FRET | TARGET |
|---|---|---|
| set 1 | 307-70-03 | 502-93-01 |
| set 2 | 307-70-03 | 502-93-02 |
| set 3 | 187-46-01 | 641-60-02 |
| set 4 | 187-46-01 | 277-68-05 |
| set 5 | 187-46-01 | 685-56-01 |
| set 6 | 187-46-01 | 641-60-03 |
| set 7 | 187-46-01 | 649-10-01 |
| set 8 | 680-17-02 | 782-70-02 |
| set 9 | 187-46-01 | 277-68-06 |
| set 10 | 187-46-01 | 491-02-02 |
| set 11 | 307-70-03 | 761-40-02 |

FRETS

| | | SEQ ID NO |
|---|---|---|
| 307-70-03 | 5'-Fam-ATTC(CY3)TCTCAGACT-NH2-3' | 2392 |
| 187-46-01 | 5'-Fam-CAAC (CY3)GCTTCCTCCG-3' | 2393 |
| 680-17-02 | 5'-Fam-CGCT (CY3)TCTCGCTCGC-3' | 2394 |

TARGETS

| | | SEQ ID NO |
|---|---|---|
| 502-93-01 | 5'-CAGTCTGAGATGAATGATACGAGAGAGT-NH2-3' | 2395 |
| 502-93-02 | 5'-CAGTCTGAGATGAATGAATGAGACGAGAGAGT-NH2-3' | 2396 |
| 641-60-02 | 5'-CGGAGGAAGAAGCAGTTGGAGGCGTGACGGT-NH2-3' | 2397 |
| 277-68-05 | 5'-CGGAGGAAGAAGCAGTTGGTGCCGCCTCGTTAA-PO4-3' | 2398 |
| 685-56-01 | 5'-GCGGAAGAAGAAGCGGTTGGTGTATCTCGGCGG-NH2-3' | 2399 |
| 641-60-03 | 5'-CGGAAGAAGCAGTTGGAGGCGTGACGGT-NH2-3' | 2400 |
| 649-10-01 | 5'-CGGAAGAAGCAGTTGTGCCGCCTCGTTAA-NH2-3' | 2401 |

FIG. 47A-73

| | |
|---|---|
| 782-70-02 | 5'-GCGAGAGAGACAGCGCAAACCTGCCGTTC-3' | 2402
| 277-68-06 | 5'-CGGAGGAAGCAGTTGTCCGCGAAGATG-3' | 2403
| 491-02-02 | 5'-CGGAAGAAGCAGTTGGAGACGTGACTGTGG-NH2-3' | 2404
| 761-40-02 | 5'-GGAGTGAGACAGCGAAAGACTGCCGTTCT-3' | 2405

Cell Lysate Kits adipocyte lipid binding protein, mouse (m-aP2)
C289 Probe Set

| | | |
|---|---|---|
| | FRET/TARGET SET 1 | |
| t | 5'-CCGCCATCTAGGGTTATGATGCTA-3' | 2406 |
| p | 5'-CTCTCTCGTCTCCTTCACCTTCCTGTCG-NH2-3' | 2407 |
| a | 3'-PO4-AGCAGAGGAAGTGGAAGGACAGC-5' | 2408 |
| a | 3'-NH2-AGCAGAGGAAGTGGAAGGACAGC-5' | 2409 |
| p | 3'-PO4-AGAGAGGAGAAGTGGAAGGACAGC-5' | 2410 |
| p | 5'-AACGAGGCGCACCTTCACCTTCCTGTCG-NH2-3; | 2411 |
| p | 5'-AACGAGGCGCACCTTCACCTTCCTGTCG-Biotin-3' | 2412 |
| a | 3'-PO4-CCGCGTGGAAGTGGAAGGACAGC-5' | 2413 |
| p | 3'-PO4-CTCCGCGTGGAGACTTCACCTTCCTGTCG-NH2 | 2414 |
| a | 5'-CATCTTCGCGGACTTCACCTTCCTGTCG-NH2 | 2415 |
| p | 3'-PO4-GCCTGAAGTGGAAGGACAGC-5' | 2416 |
| a | 3'-PO4-GCGCCTGAAGTGGAAGGACAGC-5' | 2417 |
| p | 5'CTTGCTCCCCGTGCTTCACCTTCCTGTCG-NH2 | 2418 |
| p | 5'CTTGCTCCCCGTGCTTCACCTTCCTGTCG-Biotin | 2419 |
| a | 3'-PO4-GGGCACGAAGTGGAAGGACAGC-5' | 2420 |
| a | 3'-PO4-AGGGGCACGAAGTGGAAGGACAGC-5' | 2421 |

G392 Probe Set

| | | |
|---|---|---|
| | FRET/TARGET SET 1 | |
| p | 5'-CTCTCTCGTCTCCACATTCCACCACCAG-NH2-3' | 2422 |
| t | 5'-TTGTGTAAGTCACGCCTTTCATAAT-3' | 2423 | rev-ErbA, mouse (m-revErbA
C155 Probe Set

| | | |
|---|---|---|
| | FRET/TARGET SET 4 | |
| p | 5'-AACGAGGCGCACGAAGCAGGGTAATGAATCT-NH2-3' | 2424 |
| t | 5'-CCACTCCTGAAGGCTCCGCAGTC-3' | 2425 |

Carnitine palmitolytransferase, mouse (m-CPT-1)
T352 Probe Set

| | | |
|---|---|---|
| | FRET/TARGET SET 2 | |
| p | 5'-CTCTCTCGTCTCAATGCCTGTCGCC-NH2-3' | 2426 |
| t | 5'-GCTTCAGGGTTTGTCGGAAGAAGAAC-3' | 2427 |

FIG. 47A-74

C851 Probe Set
FRET/TARGET SET 2
p  5'-CTCTCTCGTCTCGTTTGCGGGCGATACAT-NH2-3'  2428
t  5'-CGGCTTGATCTCTTCACGGTCCAC-3'  2429

Carnitine palmitolytransferase, human (h-CPT-1)
U744 Probe set
FRET/TARGET SET 2
p  5'-CTCTCTCGTCTCAACTTCAAATACCACTGTAATCT-NH2-3'  2430
i  5'-CTCACGTAATTGTAGCCCACCAGGAGTTTC-3'  2431
a  3'-NH2-GCAGAGTTGAAGTTTATGGTGACATTAGA-5'  2432
s  5'-TGGTCCAAGACCGACAGCAAAATCTTGAG-3'  2433

A456 Probe Set
FRET/TARGET SET 10
p  5'-CAGTCACGTCTCTTCAGGGAGTAGCGCA-NH2-3'  2434
i  5'-CCCGTGGTAGGAGAGCAGCACTA-3'  2435
a  3'-NH2-GCAGAGAAGTCCCTCATCGCGT-5'  2436

C759 Probe Set
FRET/TARGET SET 2
p  5'-CTCTCTCGTCTCGCCCACCAGGATT-NH2  2437
i  5'-CTCCCACCAGTGCGCTCACGTAATTTGTAA-3'  2438
a  5'-AATCTGTGGGCGAGACG-B-3'  2439
s  5'-TTAACTTCAAATACCACTGTAATCTTGGTCCAAGACCG-3'  2440

G329 Probe Set
FRET/TARGET SET 4
p  5'-ACCGAGGGCACCAATTATTCCTAACG-b-3'  2441
i  5'-GCCGTTTCCAGAGTCCGATTGATTTTGA-3'  2442
a  3'-(biotin)-GCGGTGGTTAATAAGGATTGC-5'  2443

C1763 Probe Set
FRET/TARGET SET 9
p  5'-CATCTTCGCGGAGACATTTCTTGATGATTCCTT-3'  2444
i  5'-AAAGGTGTCTGGGCTCGTGCT-3'  2445
a  3'-(biotin)-GCCTCTGTAAAGAACTACTAAGGAA-5'  2446

Phosphatidylinositol-3-phosphate p110_, human (h-PI3Kp110_)
G1045 Probe Set (FV Arm)
FRET/TARGET SET 4
p  5'-AACGAGGGCGACCAGTTTCCTCTGTG-NH2-3'  2447
i  5'-GACCAGCCCTGACATGAACTTTAC-3'  2448
a  3'-NH2-CGCGTGGTCAAAGGAGACAC-5'  2449

FIG. 47A-75

C1521 Probe Set
- FRET/TARGET SET 2
- p: 5'-CTCTCTCGTCTCGGGAGGGTAATAATAAGG-NH2-3' — 2450
- i: 5'-GCTGCCTTTCAATAATCTTATCGAAC-3' — 2451
- a: 3'NH2-AGCAGAGCCCTCCCATTATTATTCC-5' — 2452

C2667 Probe Set
- FRET/TARGET SET 2
- p: 5'-CTCTCTCGTCTCGTTGTATTCTTTAAGCCAG-NH2-3' — 2453
- i: 5'-CGGTCCAGGTCATCCCCAGAC-3' — 2454
- a: 3'NH2-AGCAGAGCAACATAAGAAATTCGGTC-5' — 2455

G537 Probe Set
- FRET/TARGET SET 2
- p: 5'-CTCTCTCGTCTCCTCGGTGGATATGTTTG-NH2-3' — 2456
- i: 5'-CTAAGTTTTCAGGGATGGATGGTTCATGC-3' — 2457
- a: 3'NH2-AGCAGAGGAGACCACCTATACAAAC-5' — 2458

T3192 Probe Set
- FRET/TARGET SET 2
- p: 5'-CTCTCTCGTCTCAACTGTGTGGGC-NH2-3' — 2459
- i: 5'-TTAAGATCTGTAGTCTTTCCGAAC-3' — 2460
- a: 3'NH2-AGCAGAGTTCACACACCCG-5' — 2461

Cartilage-derived morphogenic protein 1, human (h-CDMP1)

A831 Probe Set
- FRET/TARGET SET 6
- p: 5'-CCGTCACGCCTCCTGTTGCCTCCC-(biotin)-3' — 2462
- i: 5'-AGCCTCCAACTTCACGCTGT-3' — 2463
- a: 5'-GGGAGGCAACAGGAGGCG-(biotin)-3' — 2464

A1691 Probe Set
- FRET/TARGET SET 5
- p: 5'-CCGCCGAGATCACTGAAGAGGATGCTGATGG-(biotin)-3' — 2465
- i: 5'-ACACCACGTTGTTGGCAGAGTCAAG-3' — 2466
- a: 5'-CCATCAGCATCCTCTTCAGTGATCTCGG-(biotin)-3' — 2467 b-actin, rat (r-bACT)

C1671 Probe Set (longer)
- FRET/TARGET SET 6
- p: 5'-CCGTCACGCCTCGCCTTAGGGTTCA-NH2-3' — 2468
- i: 5'-TCTGGGTCATCTTTTCACGGTTGA-3' — 2469
- a: 3'-GCGGAGCGGAATCCCAAGT-5' — 2470
- s: 5'-GAGGGGCCTCGGTGAGC-3' — 2471

FIG. 47A-76

Bile Salt port Pump, rat (r-BSEP)

FRET/TARGET SET 5
p  5'-CCGCCGAGATCACGAGTTCTTGCCTTC-(biotin)-3'  2472
p  5'-CCGCCGAGATCACGAGTTCTTGCCTTC-NH3-3'  2473
l  5'-TTCACACACGCTTTCCTGGTATCTCC-3'  2474
a  3'-(biotin)-CTAGTGCTCAAGAACGGAAAG-5'  2475

G1288 Probe Set
FRET/TARGET SET 2
p  5'-CTCTCTCGTCTCCCAGAAGGCCAGT-(biotin)-3'  2476
l  5'-TTCTTCATCTAGGACAAGTGTGAACCATAA-3'  2477
a  5'-ACTGGCCTTCTGGGAGACG-(biotin)-3'  2478

A790 Probe Set
FRET/TARGET SET 6
p  5'-CCGTCACGCCTCTTCCTCATTCTCCT-(biotin)-3'  2479
l  5'-CCCAATTTCCATTCTCATTATTCTCCGGAAGTAAATC-3'  2480
a  5'-AGGAGAATGAGGAAAGAGGCG-(biotin)-3'  2481

Nitric Oxide Synthase 2A, human (h-iNOS2)

A3418 Probe Set
FRET/TARGET SET 6
p  5'-CCGTCACGCCTCTGTCTTTCTTCGC-(biotin)-3'  2482
l  5'-GCTGCACCGCCACCCC-3'  2483
a  5'-GCGAAGAAAGACAGAGGCG-(biotin)-3'  2484

Neutral Carboxy Ester Hydrolase, human (h-NCEH)

A1221 Probe Set
FRET/TARGET SET 7
p  5'-AACGAGGCGCACTCTCTTATTCTCCTG-B-3'  2485
p  5'-AACGAGGCGCACTCTCTTATTCTCCTG-NH2-3'  2486
l  5'-GTCTCAAAGTCCACCACAGTCTC-3'  2487
a  5'-CAGGAGAATAAGAAAGAGTGCGC-(biotin)-3'  2488

A1221 Probe Set
FRET/TARGET SET 6
p  5'-CCGTCACGCCTCTCTTCTTATTCTCC-3'  2489
p  5'-CCGTCACGCCTCTCTTCTTATTCTCC-NH2-3'  2490
l  5'-GTCTCAAAGTCCACCACAGTCTC-3'  2491
a  3'-GCGGAGAAGAAGAATAAGAGG-5'  2492
s  5'-TGGGATGGGTCCTGGGC-3'  2493

FIG. 47A-77

C1309. Probe Set
FRET/TARGET SET 8
p  5'-GAACGGCAGGTTGGCACTCTTGGCATT-NH2-3'  2494
i  5'-CAGGTAGGCGTAGGTCTTGA-3'  2495
a  3'-NH2-CGTCCAAACCGTGAGAACCGTAA-5'  2496
s  5'-GGCTCTGTGCTGGGCTA-NH2-3'  2497

Peroxisomal Proliferation Activator Protein Receptor alpha, human (h-PPAR_)
G1480 Probe Set
FRET/TARGET SET 6
p  5'-CCGTCACGCCCTCCCGACTCCGTCT-(biotin)-3'  2498
i  5'-CGGGTGCAGCGCAGCATT-3'  2499
a  5'-AGACGGAGTCGGGAGGCG-(biotin)-3'  2500

A1044 Probe Set
FRET/TARGET SET 6
p  5'-CCGTCACGCCTCTGTCACTTGATCGTTCT-(biotin)-3'  2501
i  5'-TGGCCTCATAAACTCCGTATTTTAGCAAG-3'  2502
a  5'-AGAACGATCAAGTGACAGAGGCG-(biotin)-3'  2503

C 1311 Probe Set
FRET/TARGET SET 6
p  5'-CCGCCGAGATCACGTGTCCTACGTTTAGAAG-(biotin)-3'  2504
i  5'-CACATGTACAATACCCTCCTGCATTTTTCAATC-3'  2505
a  5'-CTTCTAAACGTAGGACACGTGATCTCGG-(biotin)-3'  2506

Peroxisomal Proliferation Activator Protein Receptor beta, human (h-PPAR_)
A595 Probe set
FRET/TARGET SET 6
6B. Designed truncated probe and stackers to reduce temperature
p  5'-CCGTCACGCCTCTCTTCTGAATCTTGC-3'  2507
i  5'-CTGGCACTTGTTGCGGTTCTA-3'  2508
a  3'-NH2-GCGGAGAGAAGACTTAGAACG-5'  2509
s  5'-AGCTGCGCTCACACTTCTCGT-3'  2510

6C. Design for new INVADER assay with 50% 2'-Me.
FRET/TARGET SET 6
p  5'-CCGTCACGCCTCTCTTCTGAATCTTG-NH2-3'  2511
i  5'-CTGGCACTTGTTGCGGTTCTA-3'  2512
a  3'-NH2-GCGGAGAGAAGACTTAGAAC-5'  2513
s  5'-CAGCTGCGCTCACACTTCTCGT-NH2-3'  2514

FIG. 47A-78

6D. Truncate probe.

FRET/TARGET SET 6
5'-CCGTCACGCCTCTCTTGAATCTT-NH2-3'   2515
5'-CCTGGCACTTGTTGCGGTTCTA-3'         2516
5'-GCAGCTGCGCTCACACTTCTCGT-NH2-3'    2517

C891 Probe Set

FRET/TARGET SET 7
5'-AACGAGGCGCACGGTAGGCATTGTAGA-3'    2518
5'-CCTTCTTTTGGTCATGTTGAAGTTTTCAC-3'  2519
3'-CGCGTGCCATCCGTAACATCT-5'          2520
5'-TGTGCTTGGGAGAAGGCCTTCA-3'         2521

Substance P, rat (r-SubP)
C344 Probe Set

FRET/TARGET SET 6
5'-CCGTCACGCCTCGCCACTTGTTTTCA-NH2-3' 2522
5'-CCATGCCCATAAAGAGCCTTTAACAGGA-3'   2523
3'-NH2-GCGGAGCGGTGAACAAAAAGT-5'      2524
NO STACKER

A396 Probe Set

FRET/TARGET SET 6
5'-CCGTCACGCCTCTCTTATGCCTTTGTGA-NH2-3'  2525
5'-TGCCCATTAGTCCAACAAAGGAATCTGTA-3'     2526
3'-GCGGAGAAATACGGAAAACACT-5'            2527
5'-GAGATCTGACCATGCCCATAAAGAGCC-NH2-3'   2528

C752 Probe Set

FRET/TARGET SET 7
5'-AACGAGGCGCACGCTGGCAAACTTGT-NH2-3'    2529
5'-CCTTCTGTCTTTGGAGACTTGCATCA-3'        2530
3'-NH2-CGCGTGCGACCGTTTGAACA-5'          2531
5'-ACAACTCCATCAACACTGTGCTTTGCTG-NH2-3'  2532

Hepatic Lipase, human (h-LIPC)
A830 Probe Set

FRET/TARGET SET 7
5'-AACGAGGCGCACTCTAGGAAGTGGCA-NH2-3'    2533
5'-GTGCTGGGCAATATGTCTGTAGAGCG-3'        2534
3'-NH2-CGCGTGAGATCCTTCACCGT-5'          2535
5'-GCCAGGCTGGAAGGAGC-NH2-3'             2536

C1154 Probe Set

FRET/TARGET SET 5

FIG. 47A-79

Hepatic Lipase, rat (r-LIPC)
G357 Probe Set
- p: 5'-CCGCCGAGATCACCGTCTCAGTTTGGT-NH2-3'  2537
- l: 5'-CGAGTAGTGACATGGTAAAAGTTGTTGTATTGGCT-3'  2538
- a: 3'-NH2-CTCTAGTGGCAGAGTCAAACCA-5'  2539

FRET/TARGET SET 5
- p: 5'-CCGCCGAGATCACCACGTTCACGGGTT-NH2-3'  2540
- l: 5'-GGGAGATCCAGTCCACTAATCCA-3'  2541
- a: 3'-NH2-TCTAGTGGTGCAAGTGCCCAA-5'  2542
- s: 5'-GGGACTGTCGGGACTTCAGG-NH2-3'  2543

C1167 Probe Set
- p: 5'-GAACGGCAGGTTTGGGAATTTCTTATTTCTT-NH2-3'  2544
- l: 5'-ATTCCTTCGCCCAGGGTGATG-3'  2545
- a: 3'-NH2-GTCCAAACCCTTAAAAGAAATAAAGAA-5'  2546
- s: 5'-CTTTTGTCCCCAGCAGTGT-NH2-3'  2547

Metabotropic Glutamate Receptor 2, rat (r-mGluR2)
C1403 Probe Set
- p: 5'-AACGAGGCGCACGGTGGTGTTGGGA-NH2-3'  2548
- l: 5'-GCCTCATAGCATCGCAGAGGTGT-3'  2549
- a: 3'-NH2-CGCGTGCCACCACAACCCT-5'  2550
- s: 5'-CAGAGGGCACGGTGCATGTTGT-NH2-3'  2551

FRET/TARGET SET 7

G-protein coupled receptor 2, rat (r-ETBR-LP2)
A1629 Probe set
- p: 5'-GAACGGCAGGTTTGTCAGCAGACCGC-NH2-3'  2552
- l: 5'-GAGAGGCCAAAGTGAGACCATGTGAAAGAAA-3'  2553
- a: 3'-NH2-CGTCCAAACAGTCGTCTGGCG-5'  2554
- s: 5'-CATGGATCGGCATGGCCCC-NH2-3'  2555

FRET/TARGET SET 8

I kappa b alpha, human (h-MAD3)
C542 Probe Set
- p: 5'-AACGAGGCGCACGGTGTAGGGGGG-(biotin)-3'  2556
- l: 5'-GCCCTGCTCACAGGCAAT-3'  2557
- a: 5'-CCCCCCTACACCCGTGCGC-(biotin)-3'  2558

C363 Probe Set

FRET/TARGET SET 6

FIG. 47A-80

G953 Probe Set

| | | | SEQ ID |
|---|---|---|---|
| p | 5'-CCGTCACGCCTCGTCAGTGCCTTTC-(biotin)-3' | | 2559 |
| l | 5'-CACCTGGCGGATCACTTCCATGT | | 2560 |
| A | 5'-GAAAAGGCACTGACGAGGCG-(biotin)-3' | | 2561 |

FRET/TARGET SET 6

| p | 5'-CCGTCACGCCTCCTCCATCCTCACT-(biotin)-3' | 2562 |
|---|---|---|
| l | 5'-ACTCTGACTCTGTGTCATAGCTCT | 2563 |
| A | 5'-AGTGAGGATGAGGAGGCG-(biotin)-3' | 2564 |

C923 Probe Set

FRET/TARGET SET 7

| p | 5'-AACGAGGCGCACGGTTTCTAGTGTCA-NH2-3' | 2565 |
|---|---|---|
| l | 5'-CTCACTCTCTGGCAGCATCTGAAT-3' | 2566 |
| A | 3'-NH2-CGCGTGCCAAAAGATCACAGT-5' | 2567 |
| s | 5'-GCTGGCCCAGCTGC-NH2-3' | 2568 |

Lecithin cholesterol acyltransferase, human (h-LCAT)

C821 Probe Set (truncated Probe Design)

FRET/TARGET SET 5

| p | 5'-CCGCGAGATCACGGTTATGCGCTG-NH2-3' | 2569 |
|---|---|---|
| l | 5'-CCAGGGGGAGGTGGTC-3' | 2570 |
| a | 3'-NH2-TCTAGTGCCAATACGCGACG-5' | 2571 |
| s | 5'-CTCCTCTTTCAGCTTGATGCTGG-NH2-3' | 2572 |

C827 Probe Design

FRET/TARGET SET 8

| p | 5'-GAACGGCAGGTTTGGGTGGTGGTTATGCG-NH2-3' | 2573 |
|---|---|---|
| l | 5'-AGAGGGAAACATCCAGGGGGAG-3' | 2574 |
| a | 3'-NH2-CGTCCAAACCACCACCAATACGC-5' | 2575 |

C1217 Probe Design

FRET/TARGET SET 5

| p | 5'-CCGCCGAGATCACGAGAGATGCTGTATCCC-NH2-3' | 2576 |
|---|---|---|
| l | 5'-GGTCAGGTTGCTGAAGACCATGTTG-3' | 2577 |
| a | 3'-NH2-TCTAGTGCTCTACGACATAGGG-5' | 2578 |

Apolipoprotein A-1, human (h-ApoA1)

A177 Probe Set

FRET/TARGET SET 6

| p | 5'-CCGTCACGCCCTCTGAGCACATCCACG-NH2-3' | 2579 |
|---|---|---|
| l | 5'-ACATAGTCTCTGCCGCTGTCTTA-3' | 2580 |
| a | 3'-NH2-GCGGAGACTCGTGTAGGTGC-5' | 2581 |
| s | 5'-TACACAGTGGCCAGGTCCTT-NH2-3' | 2582 |

FIG. 47A-81

A227 Probe Set (titrate length of 2'-O-Me in Invader)

FRET/TARGET SET 8
- p   5'-GAACGGCAGGTTGTCCCAAGGCGG-NH2-3'                              2583
- i   5'-GTCAAGGAGCTTTAGGTTAGCTGTTTA-3'                               2584
- i   5'-GTCAAGGATCTTTAGGTTAGCTGTTTA-3'                               2585
- i   5'-GTCCCAGTTGTCAAGGATCTTTAGGTTAGCTGTTTA-3'                      2586
- A   3'-NH2-GTCCAAACAGGGTTCCGCC-5'                                   2587
- s   5'-AGCCTTCAAACTGGGACACATAGTCTC-NH2-3'                           2588

G350 Probe Set

FRET/TARGET SET 5
- p   5'-CCGCCGAGATCACTTCTGTCTCCTT-NH2-3'                             2589
- i   5'-CTCCTGCCTCAGGCCG-3'                                          2590
- a   3'-NH2-TCTAGTGGAGACAGAGGAA-5'                                   2591
- s   5'-TTCCAGGTTATCCCAGAACTCC-NH2-3'                                2592

G233 Probe Set

FRET/TARGET SET 11
- p   5'-AGAACGGCAGTCTTTCTGTTTCCCAAGG-NH2-3'                          2593
- i   5'-CCAGTTGTCAAGGAGCTTTAGGTTAGT-3'                               2594
- a   3'-NH2-CGTCAGAAAGACAAAAGGGTTCC-5'                               2595
- s   5'-CGGAGCCTTCAAACTGGGACACATAGT-NH2-3'                           2596

Metabotropic Glutamate Receptor 1, rat (r-mGluR1)
T934 Probe Set

FRET/TARGET SET 11
- p   5'-AGAACGGCAGTCTTAGAATAGGCGATCTGT-NH2-3'                        2597
- i   5'-CACTCAGGTCTATGCTTGTGGCT-3'                                   2598
- a   3'-NH2-GTCAGAATCTTATCCGCTAGACA-5'                               2599
- s   5'-GGGATGTCGAACAGCTGGAGAAGATTCT-NH2-3'                          2600

Ubiquitin, human (h-UBIQ)
G119 Probe Set (MO4 Arm)

FRET/TARGET SET 6
- p   5'-CCGTCACGCCTCCTTTACATTTTCTATCGTATCCG-(biotin)-3'               2601
- i   5'-CCTTCCTTATCCTGGATCTTGGCA-3'                                  2602
- a   3'-(biotin)-GCGGAGGGAAATGTAAAAGATAGCATAGGC-5'                   2603

G119 Probe Set

FRET/TARGET SET 5
- p   5'-CGCCGAGATCACCTTTACATTTTCTATCGTATCCG-(biotin)-3'               2604
- i   5'-CCTTCCTTATCCTGGATCTTGGCA-3'                                  2605
- a   3'-(biotin)-CTAGTGGAAATGTAAAAGATAGCATAGGC-5'                    2606

FIG. 47A-82

G131 Probe Set

FRET/TARGET SET 9 p  5'-CATCTTCGGGGACTGATCTTGGCC-(biotin)-3'  2607
l  5'-GCTGATCAGGAGGAATTCCTCCTTATCT-3'  2608
a  3'-(biotin)-GCCTGACCTAGAACGGG-5'  2609

Scanned G119 region (ELISA format (No Arrestors)

p  5'-CTCTCTCGTCTCTTACATTTCTATCGTATCCGA-NH2-3'  2610
p  5'-CTCTCTCGTCTCTTACATTTCTATCGTATCCG-NH2-3'  2611
p  5'-CTCTCTCGTCTCTTACATTTCTATCGTATCC-NH2-3'  2612
p  5'-CTCTCTCGTCTCCCTTACATTTCTATCGTATC-NH2-3'  2613
p  5'-CTCTCTCGTCTCGTCGCCTTACATTTCTATCG-NH2-3'  2614
l  5'-GGAATTCCTTCCTTATCCTGGATCTTGA-3'  2615
l  5'-GGAATTCCTTCCTTATCCTGGATCTTGGC-3'  2616
l  5'-CCTTCCTTATCCTGGATCTTGGCA-3'  2617
l  5'-CTTCCTTATCCTGGATCTTGGCCA-3'  2618
l  5'-TCCTTATCCTGGATCTTGGCCTA-3'  2619

Ubiquitin, mouse (m-UBIQ)

G294 Probe Set

FRET/TARGET SET 7 p  5'-CCGTCACGCCTCCCTTCTGGATGTTGTA-(biotin)-3'  2620
l  5'-CCAGGTGCAGGGTTGACTA-3'  2621
a  3'-(biotin)-GCGGAGGGAAGACCTACAACAT-5'  2622

G294 Probe Set

FRET/TARGET SET 5 p  5'-CGCCGAGATCACCCTTCTGGATGTTGTA-(biotin)-3'  2623
l  5'-CCAGGTGCAGGGTTGACTA-3'  2624
a  3'-(biotin)-CTAGTGGGAAGACCTACAACAT-5'  2625

G294 Probe Set

FRET/TARGET SET 6 p  5'-CCGTCACGCCTCCCTTCTGGATGTTGTAAT-NH2-3'  2626
l  5'-CCAGGTGCAGGGTTGACTA-3'  2627
a  3'-NH2-GCGGAGGGAAGACCTACAACATTA-5'  2628

FIG. 47A-83

FRET/TARGET SET 6
5'-CCGTCACGCCTCCCTTCTGGATGTTGTAATC-NH2-3'    2629
5'-CCAGGTGCAGGGTTGACTA-3'    2630
3'-NH2-GCGGAGGGAAGACCTACAACATTAG-3'    2631

FRET/TARGET SET 7
5'-AACGAGGCGCACATGTTGTAATCAGAGAGGG-NH2-3'    2632
5'-TGCAGGGTTGACTCTTTCTGGA-3'    2633
3'-NH2-CGCGTGTACAACATTAGTCTCTCCC-5'    2634

FRET/TARGET SET 9
5'-CATCTTCGCGGACCTTCTGGATGTTGTA-NH2-3'    2635
5'-GGACCAGGTGCAGGGTTGACTT-3'    2636
3'-NH2-GCCTGGAAGACCTACAACAT-5'    2637

FRET/TARGET SET 9
5'-CATCTTCGCGGACTTCACGTTCTCGATGG-NH2-3'    2638
5'-CCCTCTTTATCCTGGATCTTGGCA-3'    2639
3'-NH2-GGCGCCTGAAGTGCAAGAGCTACC-5'    2640

G294 Probe Set
p
l
a

T514 Probe Set
p
l
a

G750 Probe Set
p
l
a

G185 Probe Set
p
l
a

FIG. 47A-84

G294 Probe Set

FRET/TARGET SET 6
p  5'-CCGTCACGCCTCCCTTCTGGATGTTGTAATC-NH2-3'   2629
i  5'-CCAGGTGCAGGGTTGACTA-3'   2630
a  3'-NH2-GCGGAGGGAAGACCTACAACATTAG-3'   2631

T514 Probe Set

FRET/TARGET SET 7
p  5'-AACGAGGCGCACATGTTGTAATCAGAGAGGG-NH2-3'   2632
i  5'-TGCAGGGTTGACTCTTTCTGGA-3'   2633
a  3'-NH2-CGCGTGTACAACATTAGTCTCTCCC-5'   2634

G750 Probe Set

FRET/TARGET SET 9
p  5'-CATCTTCGCGGACCTTCTGGATGTTGTA-NH2-3'   2635
i  5'-GGACCAGGTGCAGGGTTGACTT-3'   2636
a  3'-NH2-GCCTGGAAGACCTACAACAT-5'   2637

G185 Probe Set

FRET/TARGET SET 9
p  5'-CATCTTCGCGGACTTCACGTTCTCGATGG-NH2-3'   2638
i  5'-CCCTCTTTATCCTGGATCTTGGCA-3'   2639
a  3'-NH2-GCGCCTGAAGTGCAAGAGCTACC-5'   2640

FIGURE 48

| | | |
|---|---|---|
| 12 | | |
| 1 | 8 | C |
| 2 | 5 | U |
| 3 | 5 | U |
| 4 | 2 | U |
| 5 | 1 | U |
| 6 | 2 | C |
| 7 | 7 | G |
| 8 | 7 | A |
| 9 | 1 | U |
| 10 | 1 | C |

FIG. 49A-1

| | Oligo Sequence (5' to 3') | SEQ ID NO |
|---|---|---|
| Secondary system | | |
| FRET probe | FL-CAC-Z28-TGC TTC GTG G | 3175 |
| Secondary Reaction Template 1 | CCA GGA AGC AAG TGG TGC GCC TCG ttt | 3176 |
| Secondary Reaction Template 2 | CCA GGA AGC AAG TGG AGG CGT GAC ggt | 3177 |

| Assays | SRT # | Oligo Type | Oligo Sequence (5' to 3') | SEQ ID NO |
|---|---|---|---|---|
| human CYP3A4 | 2 | Probe | 5'-CCG TCA CGC CTC GCC CCA CA-NH2-3' | 654 |
| | | Probe | 5'-CCG TCA CGC CTC GCC CCA CA-HEX-3' | 3178 |
| | | Invader | 5'-CAG CAC AGG CTG TTG ACC ATC ATA AAA C-3' | 655 |
| | | Stacker | 5'-cttttccatacttttatgacattc-3' | 656 |
| | | Stacker | 5'-cttttccatacttttatgacattc HEX-3' | 3179 |
| | | Arrestor | 5'-tgtgggcgaggcg-3' | 657 |
| | | Arrestor | 5'-tgtggggcgaggcg HEX-3' | 3180 |
| | | Arrestor | 5'-tgtggggcgaggcG -3' | 3181 |
| human CYP2C9 | 2 | Probe | 5'-CCG TCA CGC CTC ATG GAT AAT GCC C-NH2-3' | 646 |
| | | Probe | 5'-CCG TCA CGC CTC ATG GAT AAT GCC C-HEX-3' | 3182 |
| | | Invader | 5'-CAG GTG AGA AAA GGC ATT ACA GAT AGT GAA AGC-3' | 647 |
| | | Stacker | 5'-CAG AGG AAA GAG AGC TGC AGG G-3' | 648 |
| | | Stacker | 5'-cag agg aaa gag agc tgc agg g HEX -3' | 3183 |
| | | Arrestor | 5'-gggcattatccatgaggcg-3' | 649 |
| | | Arrestor | 5'-gggcattatccatgaggcg HEX-3' | 3184 |
| | | Arrestor | 5'-gggcattatccatgaggcG -3' | 3185 |
| h/r CYP1A2 | 1 | Probe | 5'-AAC GAG GCG CAC GGA CTG TTT TCT GC-NH2-3' | 671 |
| | | Invader | 5'-cttgtcaagtctgatAGTGCTCCTC-3' | 672 |
| | | Invader | 5'-cttgttgaagtcttgatAGTGTTCCTC-3' | 673 |
| | | Arrestor | 5'-gcagaaaacagtccgtcgc-3' | 674 |
| | | Arrestor | 5'-gcagaaaacagtccgtcgc HEX-3' | 3186 |

FIG. 49A-2

| | | | | |
|---|---|---|---|---|
| rat CYP2B2 | 2 | Probe | 5'-CCG TCA CGC CTC AGA GCC AAT CAC-NH2-3' | 679 |
| | | Probe | 5'-CCG TCA CGC CTC AGA GCC AAT CAC-HEX-3' | 3187 |
| | | Invader | 5'-CGA TCA TCA AGG GAT GGT GGC CTG TGC-3' | 680 |
| | | Stacker | 5'-CTG ATC AAT CTC CTT TTG GAC TTT CTC TGC G-3' | 681 |
| | | Stacker | 5'-CTG ATC AAT CTC CTT TTG GAC TTT CTC TGC G HEX-3' | 3188 |
| | | Arrestor | 5'-gtgattggctcgaggcg -3' | 682 |
| | | Arrestor | 5'-gtgattggctcgaggcg HEX-3' | 3189 |
| | | Arrestor | 5'-gtgattggctcgaggcG -3' | 3190 |
| human CYP2B6 | 2 | Probe | 5'- CCG TCA CGC CTC CAC CAT ATC CC-NH2-3' | 638 |
| | | Probe | 5'- CCG TCA CGC CTC CAC CAT ATC CC-HEX-3' | 3191 |
| | | Invader | 5'-CCA GCG GTT TCC ATT GGC AAA GAT CAA-3' | 639 |
| | | Stacker | 5'-cggaagaatgggtcgaccatg-3' | 640 |
| | | Stacker | 5'-cggaagaatgggtcgaccatg HEX-3' | 3192 |
| | | Arrestor | 5'-gggatatggtggaggcg-3' | 641 |
| | | Arrestor | 5'-gggatatggtggaggcg HEX-3' | 3193 |
| | | Arrestor | 5'-gggatatggtggaggcG -3' | 3194 |
| rat CYP4A3 | 1 | Probe | 5'-AAC GAG GCG CAC TTG ACA GAG TCC-NH2-3' | 1454 |
| | | Invader | 5'-GCT TCT CCC ATT TGT CTA GCA TTA TAA-3' | 1459 |
| | | Stacker | 5'-GCC ATG ATT TTG ACA TAG GGT TTG AGG ATG-3' | 1460 |
| | | Stacker | 5'-GCC ATG ATT TTG ACA TAG GGT TTG AGG ATG HEX-3' | 3195 |
| | | Arrestor | 5'-ggactctgtcaagtgcgc-3' | 1458 |
| | | Arrestor | 5'-ggactctgtcaagtgcgc HEX-3' | 3196 |

FIG. 49A-3 human NR1I2

| | | | SEQ ID |
|---|---|---|---|
| 1 | Probe | 5'- AACGAGGGCGCACGCAACTCGCA NH2-3' | 3197 |
| | Probe | 5'- AACGAGGGCGCACGCAACTCGCA HEX-3' | 3198 |
| | Probe | 5'- AACGAGGGCGCACGCAACTCGCA 3-morpholino1,2-propanediol-3' | 3199 |
| | Probe | 5'- AACGAGGGCGCACGCAACTCGCA 1,2-octanediol-3' | 3200 |
| | Probe | 5'- AACGAGGGCGCACGCAACTCGCA methoxyphenyl-3' | 3201 |
| | Probe | 5'- AACGAGGGCGCACGCAACTCGCA amine(C3)-3' | 3202 |
| | Probe | 5'- AACGAGGGCGCACGCAACTCGCA amine(C6)-3' | 3203 |
| | Invader | 5'- GGCCTGCAGAGACTCTGC -3' | 3204 |
| | Stacker | 5'- gccactgctaagcac -3' | 3205 |
| | Arrestor | 5'- tgcgagttgcgtgcgc -3' | 3206 | human ABCC2

| | | | SEQ ID |
|---|---|---|---|
| 1 | Probe | 5'- AAC GAG GCG CAC CTC CAA TCT CA NH2-3' | 3207 |
| | | 5'- AAC GAG GCG CAC CTC CAA TCT CA HEX-3' | 3208 |
| | | 5'- AAC GAG GCG CAC CTC CAA TCT CA 3-morpholino1,2-propanediol-3' | 3209 |
| | | 5'- AAC GAG GCG CAC CTC CAA TCT CA 1,2 octanediol-3' | 3210 |
| | | 5'- AAC GAG GCG CAC CTC CAA TCT CA methoxyphenyl-3' | 3211 |
| | | 5'- AAC GAG GCG CAC CTC CAA TCT CA amine(C3)-3' | 3212 |
| | | 5'- AAC GAG GCG CAC CTC CAA TCT CA amine(C6)-3' | 3213 |
| | Invader | 5'- CCC CCA CTA AGA TTT ATA CCC TTC TA-3' | 3214 |
| | Stacker | 5'- gcc aaa tct cct cca -3' | 3215 |
| | Arrestor | 5'-tga gat tgg agg tgc gc-3' | 3216 |

FIG. 49A-4

| Secondary system | Oligo Sequence (5' to 3') | SEQ ID NO |
|---|---|---|
| FRET probe | FL-CAC-Z28-TGC TTC GTG G | 3217 |
| Secondary Reaction Template 1 | CCA GGA AGC AAG TGG TGC GCC TCG ttt | 3218 |
| Secondary Reaction Template 2 | CCA GGA AGC AAG TGG AGG CGT GAC ggt | 3219 |
| Secondary Reaction Template 3 | CCA GGA AGC AAG TGA CGC AGC GAC ggt | 3220 |

| Assay | SRT # | Oligo Type | Oligo Sequence (5' to 3') | SEQ ID NO |
|---|---|---|---|---|
| Human CYP 2B6 | 1 | Probe | AACGAGGCGCACCACCATATCC-NH₂ | 3221 |
| | | Invader | CCAGCGGTTTCCATTGGCAAAGATCAA | 639 |
| | | Stacker | ccggaagaatgggtcgaccatg | 3222 |
| | | Arrestor | ggatatggtgtcgc | 3223 |
| | | Stacker | ccggaagaatgggtcgac | 3224 |
| Human CYP 2B6 e6 | 2 | Probe | CCGTCACGCCTCGGTTGAGGTTC-NH₂ | 3225 |
| | | Invader | CAGCAAAGAAGAGCGAGAGCGTGTTGAC | 1911 |
| | | Stacker | tgtggctcaattcactgtg | 3226 |
| | | Arrestor | gaacctcaaccgaggcg | 3227 |
| | | Stacker | tgtggctgaattcact | 3228 |
| | 2 | Probe | CCGTCACGCCTCGGTTGAGGTT-NH₂ | 3229 |
| | | Stacker | ctgtggctgaattcactgtg | 3230 |
| | | Arrestor | aacctcaaccgaggcg | 3231 |
| | | Stacker | ctgtggctgaattcac | 3232 |
| Human CYP 2E1 | 1 | Probe | AACGAGGGCCACCGAGCCCA-NH₂ | 3233 |
| | | Invader | GCATCACCACCATGCGCTGA | 3234 |
| | | Stacker | cgtacagcgtaacaccg | 3235 |
| | | Arrestor | gcatcaccaccatgcgctga | 3236 |

FIG. 49A-5

| | | | |
|---|---|---|---|
| 1 | Probe | AACGAGGCGCACCCTGAGTGC-NH₂ | 3237 |
| | Invader | GCTGGCCTTGGGTCTTA | 3238 |
| | Stacker | ttccaggaagtg | 3239 |
| | Arrestor | gcactcagggtgcgc | 3240 |
| 1 | Probe | AACGAGGCGCACCCACGAGCA-NH₂ | 3241 |
| | Invader | CTGTGCTTTCCTTCTCCATTTA | 3242 |
| | Stacker | ggcagtcggtgagg | 3243 |
| | Arrestor | tgtctgtgggtgcgc | 3244 |
| 1 | Probe | AACGAGGGCGCACTTGGCAGCACTAC-NH₂ | 3245 |
| | Invader | GGTTGTCATACAAAACAGAGTCCAGAGA | 3246 |
| | Invader | gtcatacaaaacaGAGTCCAGAGA | 3247 |
| | Stacker | gactgtgccctgg | 3248 |
| | Arrestor | gtagtgccaagtgcgc | 3249 |
| 1 | Probe | AACGAGGCGCACTTGGCAGGACA-NH₂ | 3250 |
| | Invader | gctacagaaatgagggcaAAAAGATGAGA | 3251 |
| | Stacker | ctcagcagaaggatgg | 3252 |
| | Arrestor | tgtcctgccaagtgcgc | 3253 |
| | Stacker | ctcagcagaggatgg | 3254 |
| 2 | Probe | CCGTCACGCCCTCTTGGCAGGACA-NH₂ | 3255 |
| | Arrestor | tgtcctgccaagaggcg | 3256 |
| 1 | Probe | AACGAGGCGCACTTGGCAGGAC-NH₂ | 3257 |
| | Stacker | actcagcagaaggatgg | 3258 |
| | Arrestor | gtcctgccaagtgcgc | 3259 |
| 1 | Probe | AACGAGGCGCACTTGGCAGGA-NH₂ | 3260 |
| | Stacker | cactcagcagaaggatgg | 3261 |
| | Arrestor | tcctgccaagtgcgc | 3262 |

Rat CYP 4A2

FIG. 49A-6

| | | | | SEQ ID |
|---|---|---|---|---|
| Rat CYP 4A2 | 1 | Probe | AACGAGGCGCACCCGATTGTCC-NH₂ | 3263 |
| | | Invader | gatttcaagaacattaATTCATGATGA | 3264 |
| | | Stacker | caagactctgagaactgaagg | 3265 |
| | | Arrestor | ggacaatcgggtgcgc | 3266 |
| | 2 | Probe | CCGTCACGCCCTCCCGATTGTCC-NH₂ | 3267 |
| | | Arrestor | ggacaatcgggaggcg | 3268 |
| Rat CYP 4A2 | 1 | Probe | AACGAGGCGCACTACTATTATTTCATAG-NH₂ | 3269 |
| | | Invader | CATTTCTATCTACTGTTCTGCATCAGA | 3270 |
| | | Stacker | aaaagatgaggcatacattaatttc | 3271 |
| | | Arrestor | ctatgaaataatagtgtcgc | 3272 |
| | 1 | Probe | AACGAGGCGCACTACTATTATTTCATAGA-NH₂ | 3273 |
| | | Stacker | aaagatgaggcatacattaatttc | 3274 |
| | | Arrestor | tctatgaaataatagtgtcgc | 3275 |
| | 2 | Probe | CCGTCACGCCCTCTACTATTATTTCATAGA-NH₂ | 3276 |
| | | Arrestor | tctatgaaataatagtagaggcg | 3277 |
| Rat CYP 4A2 | 1 | Probe | AACGAGGCGCACAGGTGTCTGGAG-NH₂ | 3278 |
| | | Invader | GGTCCACGCCACAAGCTGGGAC | 3279 |
| | | Stacker | taaaagctacagaaatgagggc | 3280 |
| | | Arrestor | ctccagacacctgtgcgc | 3281 |
| | 2 | Probe | CCGTCACGCCCTCAGGTGTCTGGAG-NH₂ | 3282 |
| | | Arrestor | ctccagacacctgaggcg | 3283 |
| | 1 | Probe | AACGAGGCGCACAGGTGTCTGGAGT-NH₂ | 3284 |
| | | Stacker | aaaagctacagaaatgagggc | 3285 |
| | | Arrestor | actccagacacctgtgcgc | 3286 |

FIG. 49A-7

| | | | | SEQ ID |
|---|---|---|---|---|
| Rat CYP Pan 3A | 2 | Probe | CCGTCACGCCTCGTTCCTGGG-NH₂ | 2028 |
| | | Invader (degenerate) | GAGCAAACCTCATGYCAATRCAC | 3287 |
| | | Stacker (degnerate) | tccattYccaaagggcag | 3288 |
| | | Arrestor | cccaggaacgaggcg | 2034 |
| Rat CYP 4A3 | 1 | Probe | AACGAGGCGCACTTTGCTCCC-NH₂ | 3289 |
| | | Invader | GGTCATAGAGACAGGACTCGTGA | 3290 |
| | | Stacker | tgagagccactgtaag | 3291 |
| | | Arrestor | gggagcaaaagtgcgc | 3292 |
| | 2 | Probe | CCGTCACGCCCTCTTTTGCTCCC-NH₂ | 3293 |
| | | Arrestor | gggagcaaaagaggcg | 3294 |
| Rat CYP 4A3 | 1 | Probe | AACGAGGCGCACGTTGTGATACCTT-NH₂ | 3295 |
| | | Invader | gatgaaggccataaatAAAATTGTGC | 3296 |
| | | Stacker | tgggtatggaacgtcc | 3297 |
| | | Arrestor | aagtatcacaacgtgcgc | 3298 |
| | 2 | Probe | CCGTCACGCCTCGTTGTGATACCTT-NH₂ | 3299 |
| | | Arrestor | aaggtatcacaacgaggcg | 3300 |
| | 1 | Probe | AACGAGGCGCACTTGTGATACCTT-NH₂ | 3301 |
| | | Invader | gatgaaggccataaattaAAAATTGTGGA | 3302 |
| | | Stacker | gggtatgaacgtccat | 3303 |
| | | Arrestor | aaagtatcacaagtgcgc | 3304 |
| | 2 | Probe | CCGTCACGCCTCTTGTGATACCTTT-NH₂ | 3305 |
| | | Arrestor | aaaggtatcacaagaggcg | 3306 |

FIG. 49A-8

| | | | | |
|---|---|---|---|---|
| Rat CYP 4A3 | 1 | Probe | AACGAGGCGCACCCATAGGGACC-NH₂ | 3307 |
| | | Invader | CCATTCTTGGACTTCAAACACAAGTCTTGA | 3308 |
| | | Stacker | gggatcctggtgg | 3309 |
| | | Arrestor | ggtcccatgggtgcgc | 3310 |
| | 2 | Probe | CCGTCACGCCCTCCCATAGGGACC-NH₂ | 3311 |
| | | Arrestor | ggtcccatgggaggcg | 3312 |
| Rat CYP 4A3 | 1 | Probe | AACGAGGCGCACATGACGGGACAC-NH₂ | 3313 |
| | | Invader | GCTACAGAAATGAGGGCAAAAAAATGAGC | 3314 |
| | | Stacker | tcagcagagatggg | 3315 |
| | | Arrestor | gtgtccgtcatgtgcgc | 3316 |
| | 2 | Probe | CCGTCACGCCTCATGACGGGACAC-NH₂ | 3317 |
| | | Arrestor | gtgtccgtcatgagcg | 3318 |
| Human/Mouse HES-1 | 1 | Probe | AACGAGGCGCACTGACTTTCTGTG-NH₂ | 3319 |
| | | Invader | CGTCTTTTCTCCATAATAGGCTTTGAA | 3320 |
| | | Stacker | atcagatgtctttggt | 3321 |
| | | Stacker | cacagaaagtcagtgcgc | 3322 |
| | | Stacker | gtcagatgtctttggt | 3323 |
| | | Stacker | ctaagatgtctttggt | 3324 |
| | | Stacker | ctgagatgtgtctttggt | 3325 |
| | | Stacker | atcagaggccgtctttggt | 3326 |
| | | Stacker | atcagaggccgtctttg | 3327 |
| rat HSP70-1,2 | 1 | Probe | 5'- AAC GAG GCG CAC CCG GTT CTC NH2-3' | 3328 |
| | | Invader | 5'- GAT CTC CTC CGG GTA GAA CGA A -3' | 3329 |
| | | Stacker | 5'- gcc ctt gta gtt cac -3' | 3330 |
| | | Arrestor | 5'-gag aac cgg gtg cgc -3' | 3331 |
| rat HSP70-1,2 | 1 | Probe | AACGAGGCGCACACTCGAAGC-NH₂ | 3332 |
| | | Invader | GGCGGGATGCCGCTCAC | 3333 |
| | | Stacker | gcccagcagg | 3334 |
| | | Arrestor | gcttcgagtgtgcgc | 3335 |

FIG. 49A-9

| | | | | |
|---|---|---|---|---|
| rat HSP70-1,2 | 1 | Probe | AACGAGGCGCACGGTACGCCT-NH₂ | 3336 |
| | | Invader | CACCGGGTGGCCCAC | 3337 |
| | | Stacker | cggcgatctcctta | 3338 |
| | | Arrestor | aggcgtaccgtgcgc | 3339 |
| | 1 | Probe | AACGAGGCGCACGGTACGCCTC-NH₂ | 3340 |
| | | Stacker | ggcgatctccttcat | 3341 |
| | | Arrestor | gaggcgtaccgtgcgc | 3342 |
| | 2 | Probe | CCGTCACGCCTCGGTACGCCTC-NH₂ | 3343 |
| | | Arrestor | gaggcgtaccgaggcg | 3344 |
| | 1 | Probe | AACGAGGCGCACGTACGCCTC-NH₂ | 3345 |
| | | Invader | ACCGGGTGGCCCAGC | 3346 |
| | | Arrestor | gaggcgtacgtgcgc | 3347 |
| | 3 | Probe | CCGTCGCTGCGTGCTCAACTC-NH₂ | 3348 |
| | | Invader | GCCGGCGGGATGCCC | 3349 |
| | | Stacker | gaagcgcccag | 3350 |
| | | Arrestor | gagttgagcacgcagc | 3351 |
| rat HSP70-1,2,3 | 1 | Probe | AACGAGGCGCACCAGCACCATG-NH₂ | 3352 |
| | | Invader | GCGATCTCCTTCATCTTGGTA | 3353 |
| | | Invader | CAGTCTCCTTCATCTTGGTA | 3354 |
| | | Stacker | gcgatctcttcatcttggta | 3355 |
| | | Arrestor | catggtgctggtgcgc | 3356 |
| rat HSP70-1,2,3 | 1 | Probe | AACGAGGCGCACCATGGCCC-NH₂ | 3357 |
| | | Invader | CAGGTTGTTGTCGCGCGTA | 3358 |
| | | Invader | GAGGTTGTTGTCGCGCGTA | 3359 |
| | | Stacker | tctcgccctcgta | 3360 |
| | | Arrestor | gggccatggtgcgc | 3361 |

FIG. 49A-10

| | | | | |
|---|---|---|---|---|
| rat HSP70-1,2,3 | 1 | Probe | AACGAGGCGCACCACCTGGATCA-NH2 | 3362 |
| | | Invader | CCCTCTCGCCCCTCGTAA | 3363 |
| | | Stacker | gcacccgggc | 3364 |
| | | Arrestor | tgatcaggtgtgcgc | 3365 |
| rat HSP70-1,2,3 | 1 | Probe | AACGAGGCGCACTCAGCACCA-NH2 | 3366 |
| | | Invader | GGCGATCTCCTTCATCTTGGA | 3367 |
| | | Invader | TGCAGTCTCCTTCATCTTGGA | 3368 |
| | | Stacker | tggacgagatcctc | 3369 |
| | | Arrestor | tggtgctgagtgcgc | 3370 |
| Human AGC 1,2 | 1 | Probe | AACGAGGCGCACCACTAGCTC-NH2 | 3371 |
| | | Invader | AGTTCAGTTCCTGAAGGGAGTA | 3372 |
| | | Stacker | tcccactaatgtccagc | 3373 |
| | | Arrestor | gagctagtgggtgcgc | 3374 |
| Human AGC 1,2 | 1 | Probe | AACGAGGCGCACCCTTGTCTC-NH2 | 3375 |
| | | Invader | CGTCCTCACACACCAGGAAACTCATA | 3376 |
| | | Stacker | catagcagcttcc | 3377 |
| | | Arrestor | gagacaagggtgcgc | 3378 |
| rat GRM1 | 1 | Probe | AACGAGGCGCACCTTCTCATCTC-NH2 | 3379 |
| | | Invader | GCATCGGTTCAGCCCATCA | 3380 |
| | | Stacker | ggatgaaatcagggagt | 3381 |
| | | Arrestor | gagatgagaaggtgcgc | 3382 |
| | 2 | Probe | CCGTCACGCCTCCTTCTCATCTC-NH2 | 3383 |
| | | Arrestor | gagatgagaaggggcg | 3384 |
| | 3 | Probe | CCGTCGCTGCGTCTTCTCATCTC-NH2 | 3385 |
| | | Arrestor | gagatgagaagacgcag | 3386 |

FIG. 49A-11

| | | | | |
|---|---|---|---|---|
| rat GRM1 | 1 | Probe | AACGAGGGCACCCTTCTCATC-NH₂ | 3387 |
| | | Invader | GCATCGGTTCAGCCCATA | 3388 |
| | | Stacker | tcggatgaaatcagggag | 3389 |
| | | Arrestor | gatgagaagggtgcgc | 3390 |
| | 2 | Probe | CCGTCACGCCTCCCTTCTCATC-NH₂ | 3391 |
| | | Arrestor | gatgagaagggaggcg | 3392 |
| rat GRM2 | 1 | Probe | AACGAGGCGCACGAGAGATGAGGAGAGGG-NH₂ | 3393 |
| | | Invader | GGGCCAGGAAAGGACAGACAGGAAA | 3394 |
| | | Arrestor | ccctcctccatctctcgtgcgc | 3395 |
| rat GRM2 | 1 | Probe | AACGAGGCGCACGAGAGATGAGGAGAGG-NH₂ | 3396 |
| | | Invader | GCCAGGAAAGGACACAGGAAC | 3397 |
| | | Arrestor | cctctcctccatctctcgtgcgc | 3398 |
| rat GRM5 | 1 | Probe | AACGAGGCGCACTGGAGGAAACTCAG-NH₂ | 3399 |
| | | Invader | ggaattcaagctaataaaGATATCATGAA | 3400 |
| | | Stacker | agctccaataggtacagcc | 3401 |
| | | Arrestor | ctgagtttcctccagtgcgc | 3402 |
| rat GRM5 | 1 | Probe | AACGAGGGCCACTCCTTTCCAAG-NH₂ | 3403 |
| | | Invader | CAAGAGTGTGGGATCTGAGTTGAA | 3404 |
| | | Stacker | gtatgcagcatgcc | 3405 |
| | | Arrestor | cttggaaaggagtgcgc | 3406 |
| | | Stacker | gtatgcagcatggcctcctc | 3407 |
| rat GRM5 | 1 | Probe | AACGAGGGCCACTCGGCCCA-NH₂ | 3408 |
| | | Invader | CCATCTGTCACGTCATACCTGA | 3409 |
| | | Stacker | gccatcactgccc | 3410 |
| | | Arrestor | tgggccgagtgcgc | 3411 |
| | | Invader | ccatcgtcacGTCATACCTGA | 3412 |

FIG. 49A-12

| | | | | SEQ ID |
|---|---|---|---|---|
| rat GRM7 | 1 | Probe | AACGAGGGCGCACGTCCTGTGC-NH₂ | 3413 |
| | | Invader | AGTCTTTCCAATTCGCTCCTC | 3414 |
| | | Stacker | atttgcgatctgtcttc | 3415 |
| | | Arrestor | gcacaggacgtgcgc | 3416 |
| | 2 | Probe | CCGTCACGCCTCGTCCTGTGC-NH₂ | 3417 |
| | | Arrestor | gcacaggacgaggcg | 3418 |
| rat TAC1 | 1 | Probe | AACGAGGCGCACCTTCTTTCATAAG-NH₂ | 3419 |
| | | Invader | CTTCTTTCGTAGTTCTGCATTGCGA | 3420 |
| | | Stacker | cccacagaattaaagctctttg | 3421 |
| | | Arrestor | cttatgaaagaaggtgcgc | 3422 |
| | 2 | Probe | CCGTCACGCCTCCTCTTCTTTCATAAG-NH₂ | 3423 |
| | | Arrestor | cttatgaagaaggaggcg | 3424 |
| rat CYP 7A1 | 2 | Probe | CCG TCA CGC CTC GTC TTG GCC-NH2 | 3425 |
| | | Invader | 5' GCC CAG AGA ATA GCG AGG TGC A 3' | 3426 |
| | | Stacker | 5' ttc tcc atg tcg tca aag gtg g 3' | 3427 |
| | | Arrestor | 5' ggc caa gac gag gcg 3' | 3428 |
| human PPAR-alpha | 1 | Probe | AACGAGGCGCACCTTTCAGTTTTG-NH₂ | 3429 |
| | | Invader | TCTATGTCATGTTCACAGGTAAGAATTCTGA | 3430 |
| | | Stacker | ctttctcagatcttggc | 3431 |
| | | Arrestor | caaaactgaaagtgcgc | 3432 |
| | 2 | Probe | CCGTCACGCCTCCTTTCAGTTTTG-NH₂ | 3433 |
| | | Arrestor | caaaactgaaaggaggcg | 3434 |

FIG. 49A-13

| Assays | | Secondary system | Oligo Sequence (5' to 3') | SEQ ID NO |
|---|---|---|---|---|
| rat GPCR/CNS2 | | FRET probe | FL-CAC-Z28-TGC TTC GTG G | 3435 |
| | | Secondary Reaction Template 1 | CCA GGA AGC AAG TGG TGC GCC TCG ttt | 3436 |
| | | Secondary Reaction Template 2 | CCA GGA AGC AAG TGG AGG CGT GAC ggt | 3437 |
| | | Secondary Reaction Template 3 | CCA GGA AGC AAG TGA CGC AGC GAC ggt | 3438 |

| Assays | SRT # | Oligo Type | Oligo Sequence (5' to 3') | SEQ ID NO |
|---|---|---|---|---|
| human P53AIP1 | 1 | Probe | AACGAGGGCGCACTCAGTGGAGAG - NH2 | 3439 |
| | | Invader | GGTCTGCCTCGTGAGCA | 3440 |
| | | Stacker | gtaagccaccacgatg | 3441 |
| | | Arrestor | tctccactgagtgcgc | 3442 |
| human P53AIP1 | 1 | Probe | 5'- AACGAGGGCGCACCCAGGTGTG-NH2-3' | 3443 |
| | | Invader | 5'-TCACTGCAGGGACTTACCCAGA- 3' | 3444 |
| | | Stacker | tgtgtctgagccc | 3445 |
| | | Arrestor | acacctgggtgcgc | 3446 |
| human P53AIP1 | 1 | Probe | AACGAGGGCGCACCCAGGTGT NH2 | 3447 |
| | | Stacker | gtgtctgagccc | 3448 |
| human P53AIP1 | 1 | Probe | AACGAGGGCGCACCCTTCCTCT NH2 | 3449 |
| | | Invader | GGAGGAGGGGCTGGA | 3450 |
| | | Stacker | tgggactattgatcaggg | 3451 |
| | | Arrestor | agaggaaggtgcgc | 3452 |
| human P53AIP1 | 1 | Probe | AACGAGGGCGCACCTTCATTATTGGC NH2 | 3453 |
| | | Invader | CCACAAGCTTCCGAGTGCGTCATA | 3454 |
| | | Stacker | cacaggaaacgactlcttgg | 3455 |
| | | Arrestor | gccaataatgaaggtgcgc | 3456 |

FIG. 49A-14

| | | | |
|---|---|---|---|
| human P53AIP1 | 1 Probe | AACGAGGGGCACCGCTGCGT NH2 | 3457 |
| | Invader | GGCCCTGCACCTCAGAA | 3458 |
| | Stacker | gtgagcttctgggg | 3459 |
| | Arrestor | acgcagcggtgcgc | 3460 |
| mouse LLPL | 1 Probe | AACGAGGGGCACCTGTCCGTC NH2 | 3461 |
| | Invader | CAGATTCAGCCAGAGTGTGAAGTAGA | 3462 |
| | Stacker | ttcttggagcaaaggtag | 3463 |
| | Arrestor | agacggacaggtgcgc | 3464 |
| mouse LLPL | 1 Probe | AACGAGGGGCACCTGTCCGTCT NH2 | 3465 |
| | Stacker | tcttggagcaaaggtagt | 3466 |
| mouse LLPL | 1 Probe | AACGAGGGCCACCCAGAGTGTG NH2 | 3467 |
| | Invader | GCAGAAGCAGTTCCAGATTCAGA | 3468 |
| | Stacker | aagtagctgtccgtct | 3469 |
| | Arrestor | cacactctgggtgcgc | 3470 |
| mouse LLPL | 1 Probe | AACGAGGGCCACCCAGAGTGT NH2 | 3471 |
| | Stacker | gaagtagctgtccgtc | 3472 |
| mouse LLPL | 1 Probe | AACGAGGGCGCACCAGAAAGTAGAGCA NH2 | 3473 |
| | Invader | AGACTTGTGGCTGCCGCTGA | 3474 |
| | Stacker | tgtacacgttgcccatg | 3475 |
| | Arrestor | tgctctacttctggtgcgc | 3476 |

FIG. 49A-15

| Assays | | Secondary system | Oligo Sequence (5' to 3') | SEQ ID NO |
|---|---|---|---|---|
| mArbp | | FRET probe | FL-CAC-Z28-TGC TTC GTG G | 3477 |
| | | Secondary Reaction Template 1 | CCA GGA AGC AAG TGG TGC GCC TCG ttt | 3478 |
| | | Secondary Reaction Template 2 | CCA GGA AGC AAG TGG AGG CGT GAC ggt | 3479 |
| | | Secondary Reaction Template 3 | CCA GGA AGC AAG TGA CGC AGC GAC ggt | 3480 |

| | SRT # | Oligo Type | Oligo Sequence (5' to 3') | SEQ ID NO |
|---|---|---|---|---|
| mArbp | 1 | Probe | AACGAGGCGCACCATGCGGATCT NH2 | 3481 |
| | | Invader | gccttccCTCGGAGCGAA | 3482 |
| | | Stacker | gctgcatctgcttga | 3483 |
| | | Arrestor | agatccgcatggtgcgc | 3484 |
| mArbp | 1 | Probe | AACGAGGCGCACCTGCACATCAC NH2 | 3485 |
| | | Invader | CACCTTGTCTCCAGTCTTTATCAGA | 3486 |
| | | Stacker | tcagaatttcaatggtgcc | 3487 |
| | | Arrestor | gtgatgtgcaggtgcgc | 3488 |
| mArbp | 1 | Probe | AACGAGGCGCACCTGCACATCACT NH2 | 3489 |
| | | Stacker | cagaatttcaatggtcct | 3490 |
| mArbp | 1 | Probe | AACGAGGCGCACCTCCACAGACAA NH2 | 3491 |
| | | Invader | CAGTAAGTGGGAAGGTGTACTCAGTA | 3492 |
| | | Stacker | tgccaggacgct | 3493 |
| | | Arrestor | ttgtctgtggaggtgcgc | 3494 |
| mArbp | 1 | Probe | AACGAGGCGCACCTCCAGGTG NH2 | 3495 |
| | | Invader | TCTCCAGAGCTGGGTTGTTA | 3496 |
| | | Stacker | gccctgatagcc | 3497 |
| | | Arrestor | acctggaggtgcgc | 3498 |

FIG. 49A-16

| | | | | |
|---|---|---|---|---|
| mArbp | 1 | Probe | AACGAGGGCGCACCATGCGGATCTG NH2 | 3499 |
| | | Invader | GCCTTCCCTCGGAGCGAA | 3500 |
| | | Stacker | ctgcatctgcttggag | 3501 |
| | | Arrestor | cagatccgcatggtgcgc | 3502 |
| mArbp | 1 | Probe | AACGAGGGCGCACACATGCGGATCT NH2 | 3503 |
| | | Invader | GCCTTCCCTCGGAGCGC | 3504 |
| | | Stacker | gctgcatctgcttgg | 3505 |
| | | Arrestor | agatccgcatgtgtgcgc | 3506 |
| rABCB11 | 2 | Probe | CCGTCACGCCCTCCCATTATGCTACA NH2 | 3507 |
| | | Invader | TTGTCCCGTACTTGATGTTGTA | 3508 |
| | | Stacker | gtcaaacagcactggc | 3509 |
| | | Arrestor | tgtagcataatgggaggcg | 3510 |
| rABCB11 | 1 | Probe | AACGAGGCGCACCCATTATGCTACA NH2 | 3511 |
| | | Arrestor | tgtagcataatgggtgcgc | 3512 |
| rABCB11 | 1 | Probe | AACGAGGCGCACGGAGACAATCC NH2 | 3513 |
| | | Invader | GTCAAACAGCACTGGCTCCTGC | 3514 |
| | | Stacker | cgatgttggaacggaggaac | 3515 |
| | | Arrestor | ggattgtctccgtgcgc | 3516 |
| rABCB11 | 2 | Probe | CCGTCACGCCCTCGGAGACAATCC NH2 | 3517 |
| | | Arrestor | ggattgtctccgaggcg | 3518 |
| rABCB11 | 1 | Probe | AACGAGGCGCACGGATTCCGTAT NH2 | 3519 |
| | | Invader | AGCCATATCCAGAAGCAAGATCTTGC | 3520 |
| | | Stacker | gagggctgggc | 3521 |
| | | Arrestor | atacggaatccgtgcgc | 3522 |
| rABCB11 | 2 | Probe | CCGTCACGCCTCGGATTCCGTAT NH2 | 3523 |
| | | Arrestor | atacggaatccgaggcg | 3524 |

FIG. 49A-17

| Gene | | Type | Sequence | SEQ ID |
|---|---|---|---|---|
| hAPOA1 | 1 | Probe | AACGAGGGCGCACCTTCTGGC NH2 | 3525 |
| | | Invader | CTCTTGCAGCTCGTGCAGA | 3526 |
| | | Stacker | gcgcgccctct | 3527 |
| | | Arrestor | gccagaaggtgcgc | 3528 |
| hAPOA1 | 1 | Probe | AACGAGGCGCACCTTCTGGCG NH2 | 3529 |
| | | Stacker | cgcgcccttg | 3530 |
| hAPOA1 | 1 | Probe | AACGAGGCGCACCGCTGTAGG NH2 | 3531 |
| | | Invader | GCTGGGCGCAGCTCGTA | 3532 |
| | | Stacker | gggccagatgcgt | 3533 |
| | | Arrestor | cctacagcggtgcgc | 3534 |
| hLCAT | 1 | Probe | AACGAGGCGCACCTCAGCCTT NH2 | 3535 |
| | | Invader | GGCCGTGTGTGGTTACTGAGA | 3536 |
| | | Stacker | gggcgtggtgtgc | 3537 |
| | | Arrestor | aagctgaggtgcgc | 3538 |
| hLCAT | 1 | Probe | AACGAGGCGCACCTCAGCCTTG NH2 | 3539 |
| | | Stacker | ggcgtggtgtgcg | 3540 |
| hLCAT | 1 | Probe | AACGAGGCGCACCAGCCTTGG NH2 | 3541 |
| | | Invader | CCGTGTGTGGTTACTGAGCTA | 3542 |
| | | Stacker | gcgtggtgtgcgg | 3543 |
| | | Arrestor | ccaaggctggtgcgc | 3544 |
| hIVL | 1 | Probe | AACGAGGGCGCACGCTCCTTC NH2 | 3545 |
| | | Invader | GCTCCTGCTCCTGTGC | 3546 |
| | | Stacker | tgctgtttgctcacattc | 3547 |
| | | Arrestor | gaaggagcgtgcgc | 3548 |
| hIVL | 1 | Probe | AACGAGGCGCACGCTCCTTCT NH2 | 3549 |
| | | Stacker | gctgttgctcacattct | 3550 |

FIG. 49A-18

| | | | | |
|---|---|---|---|---|
| hIVL | 2 | Probe | CCGTCACGCCTCGCTCCTTCTGC NH2 | 3551 |
| | | Invader | CAGCTCCTGCTCCTGTGC | 3552 |
| | | Stacker | TGTTGCTCACATTCTTGCTCAGGC | 3553 |
| | | Arrestor | gcagaagagcgaggcg | 3554 |
| rGPR37 | 1 | Probe | AACGAGGCGCACCTGGACGTTG NH2 | 3555 |
| | | Invader | GGAAGAACAATTTTCAATCATTTCATAGTACATA | 3556 |
| | | Stacker | gtggcagcccg | 3557 |
| | | Arrestor | caacgtccaggtgcgc | 3558 |
| rGPR37 | 1 | Probe | AACGAGGCGCACATCATTTCATAGTACA NH2 | 3559 |
| | | Invader | GGCAGTGGTGGAAGAACAATTTTCAC | 3560 |
| | | Stacker | tctggacgttggtgg | 3561 |
| | | Arrestor | tgtactatgaaatgatgtgcgc | 3562 |
| rGPR37 | 1 | Probe | AACGAGGCGCACATCATTTCATAGTACATCT-NH2 | 3563 |
| | | Invader | agtttggcagtggtggaagaaCAATTTTCAG | 3564 |
| | | Stacker | ggacgttggtggcagccc | 3565 |
| | | Arrestor | agatgatactatgaaatgatgtgcgc | 3566 |
| rEsr2 (rER Beta) | 1 | Probe | AACGAGGGCCACCTCTAGTGATCT NH2 | 3567 |
| | | Invader | CTCTCTGTTTACAGGTAAGGTGTGA | 3568 |
| | | Stacker | tgcttcacaccaaggac | 3569 |
| | | Arrestor | agatactagaggtgcgc | 3570 |
| rEsr2 (rER Beta) | 2 | Probe | CCGTCACGCCTCCTCTAGTGATCTTGCT-NH2 | 3571 |
| | | Invader | GTCTCTGTTTACAGGTAAGGTGTGG | 3572 |
| | | Arrestor | agcaagatcactagagaggcg | 3573 |

FIG. 49A-19

| | | Oligo Sequence (5' to 3') | SEQ ID NO |
|---|---|---|---|
| Secondary system | | | |
| FRET probe | | FL-CAC-Z28-TGC TTC GTG G | 3574 |
| Secondary Reaction Template 1 | | CCA GGA AGC AAG TGG TGC GCC TCG ttt | 3575 |
| Secondary Reaction Template 2 | | CCA GGA AGC AAG TGG AGG CGT GAC ggt | 3576 |
| Secondary Reaction Template 3 | | CCA GGA AGC AAG TGA CGC AGC GAC ggt | 3577 |

| Assays | SRT # | Oligo Type | Oligo Sequence (5' to 3') | SEQ ID NO |
|---|---|---|---|---|
| human PTGS2 | 1 | Probe | 5'-AACGAGGCGCACAGAGGTTAGAGAAG-NH2-3' | 3578 |
| | | Invader | 5'-GGAGGAAGGGCTCTAGTATAATAGGC-3' | 3579 |
| | | Stacker | 5'-gcttccagcttttgtagc -3' | 3580 |
| | | Arrestor | 5'-cttctctaacctctgtgcgc -3' | 3581 |
| human FACL1,2 | 2 | Probe | 5'-CCGTCACGCCTCGTTGGCTCTTCCC-NH2-3' | 3582 |
| | | Invader | 5'-GGCTTGGGCTTCCGTCTC-3' | 3583 |
| | | Arrestor | 5'-gggaagagcaacgaggcg-3' | 3584 |
| rat RPS29 | 2 | Probe | 5'-CCGTCACGCCTCGCCTATGTCCTT NH2-3' | 3585 |
| | | Invader | 5'-AGGTCGCTTAGTCCAACTTAATGAAC-3' | 3586 |
| | | Stacker | 5'-cgcgtactgacggaagcactgtc-3' | 3587 |
| | | Arrestor | 5'-aaggacataggcgaggcg-3' | 3588 |
| human RPL5 | 1 | Probe | 5'-AACGAGGGCGCACGCTTCCGATGTACT NH2-3' | 3589 |
| | | Invader | 5'-GCATGTAATCTGCAACATTCTGGCCCATGATGTA-3' | 3590 |
| | | Stacker | 5'-TCTGCATTAAATTCCTTGCTTTCAGAATCATAACCAGGG-3' | 3591 |
| | | Arrestor | 5'-agtacatcgaagcgtgcgc-3' | 3592 |
| | 1 | Probe | 5'-AACGAGGGCGCACGCTTCCGA NH2-3' | 3593 |
| | | Invader | 5'-GCAACATTCTGGCCCATGATGTC-3' | 3594 |
| | | Stacker | 5'-tglactlctgcattaaattcct-3' | 3595 |
| | | Arrestor | 5'-tcggaagcgtgcgc-3' | 3596 |

FIG. 49A-20

| | | | |
|---|---|---|---|
| human CD36 | 1 | Probe | 5'-AACGAGGCGCACCTTCCGAT NH2-3' | 3597 |
| | | Invader | 5'-GCAACATTCTGGCCCATGATGTGA-3' | 3598 |
| | | Stacker | 5'-gtacttctgcattaaattcct-3' | 3599 |
| | | Arrestor | 5'-atcggaagtgcgc-3' | 3600 |
| | 2 | Probe | 5'-CCGTCACGCCTCTCTTTGCTTAAC NH2-3' | 3601 |
| | | Invader | 5'-CATTTTCCTTGGCTAGAAAACGAACTCTGTACGTATAAGGACA-3' | 3602 |
| | | Stacker | 5'-ttgaatgttgctgcttcatcatca-3' | 3603 |
| | | Arrestor | 5'-gttaagcaaagaggaggcg-3' | 3604 |
| human ALOX15 | 2 | Probe | 5'-CCGTCACGCCTCCGATTCCTTCCA NH2-3' | 3605 |
| | | Invader | 5'-CACGTCTGTCTTATAGTGGAGACTCAA-3' | 3606 |
| | | Stacker | 5'-CATACCGATAGATGATTTCCCAGAGCCGC-3' | 3607 |
| | | Arrestor | 5'-tggaaggaatcggaggcg-3' | 3608 |
| | 1 | Probe | 5'-AACGAGGCGCACCGAACAGTGT NH2-3' | 3609 |
| | | Arrestor | 5'-acactgttcggtgcgc-3' | 3610 |
| | 2 | Probe | 5'-CCGTCACGCCTCCGAACAGTGT NH2-3' | 3611 |
| | | Arrestor | 5'-acactgttcggaggcg-3' | 3612 |
| | | Invader | 5'-GCAGGGAGAAGTCAGCTTA-3' | 3613 |
| | | Stacker | 5'-gcctccctcca-3' | 3614 |
| | 1 | Probe | 5'-AACGAGGCGCACGTACTCGTAGG NH2-3' | 3615 |
| | | Arrestor | 5'-cctacgagtacgtgcgc-3' | 3616 |
| | 2 | Probe | 5'-CCGTCACGCCTCGTACTCGTAGG NH2-3' | 3617 |
| | | Arrestor | 5'-cctacgagtacgaggcg-3' | 3618 |
| | | Invader | 5'-CACGCTGGGCCGCAGC-3' | 3619 |
| | | Stacker | 5'-gcatgtccagctttg-3' | 3620 |
| human EF1alpha | 2 | Probe | 5'-CCGTCACGCCTCTTGTAGACATCCTG NH2-3' | 3621 |
| | | Invader | 5'-GCCAACAGGAACAGTACCAATACCACCAATTA-3' | 3622 |
| | | Stacker | 5'-GAGAGGCAGGCGCAAGGG-3' | 3623 |
| | | Arrestor | 5'-caggatgtctacaagaggcg-3' | 3624 |

FIG. 49A-21

| Gene | # | Role | Sequence | SEQ ID |
|---|---|---|---|---|
| mouse ABCA1 | 2 | Probe | 5' CCGTCACGCCTCCCCGTTTTC-NH2 3' | 3625 |
| | | Arrestor | 5' gaaaacggggaggcg 3' | 3626 |
| | 1 | Probe | 5'-AACGAGGCGCACCCGTTTTC NH2-3' | 3627 |
| | | Arrestor | 5'-gaaaacggggtgcgc-3' | 3628 |
| | | Invader | 5' GGGCATCTGTTGCACGTAGACAA 3' | 3629 |
| | | Stacker | 5' ttctcagatcccgtc 3' | 3630 |
| | 2 | Probe | 5'-CCGTCACGCCTCCCCGTTTTCT NH2-3' | 3631 |
| | | Invader | 5' GGGCATCTGTTGCACGTAGACAA 3' | 3632 |
| | | Stacker | 5'-tctcagatcccgtca-3' | 3633 |
| | | Arrestor | 5'-agaaaacggggaggcg-3' | 3634 |
| human ABCC2 | 1 | Probe | 5'- AAC GAG GCG CAC CTC CAA TCT CA NH2-3' | 3635 |
| | | Invader | 5'- CCC CCA CTA AGA TTT ATA CCC TTC TA -3' | 3636 |
| | | Stacker | 5'- gcc aaa tct cct cca -3' | 3637 |
| | | Arrestor | 5'- tga gat tgg agg tgc gc -3' | 3638 |
| | 1 | Probe | 5'-AACGAGGGCGCACTCGGACTGT NH2-3' | 3639 |
| | | Invader | 5'-GCCATAATGTCCAGGTTCACATCA-3' | 3640 |
| | | Stacker | 5'-ggcttccgaatcatgtt-3' | 3641 |
| | | Arrestor | 5'-acagtcgagtgcgc-3' | 3642 |
| | 1 | Probe | 5'-AACGAGGCGCACCAAAACCTGTTCA NH2-3' | 3643 |
| | | Invader | 5'-CATCCACTGTGGAAATATCGCCGGA-3' | 3644 |
| | | Stacker | 5'-caatcggcctgtg-3' | 3645 |
| | | Arrestor | 5'-tgaacaggtttggtgcgc-3' | 3646 |
| human NR1I2 | 1 | Probe | 5'- AACGAGGGCGCAGCAACTCGCA NH2-3' | 3647 |
| | | Invader | 5'- GGCCTGCAGAGACTCTGC -3' | 3648 |
| | | Stacker | 5'- gccactgctaagcac -3' | 3649 |
| | | Arrestor | 5'- tgcgagttgcgtgcgc -3' | 3650 |

FIG. 49A-22

| | | | |
|---|---|---|---|
| 1 | Probe | 5'-AACGAGGGCGCACCCTCTCTGA NH2-3' | 3651 |
| | Invader | 5'-GCCTTTTAAAAGGAAAGGGCAACCTTGA-3' | 3652 |
| | Stacker | 5'-tggtcctgacctaca-3' | 3653 |
| | Arrestor | 5'-tcagagaggtgcgc-3' | 3654 |
| 1 | Probe | 5'-AACGAGGCGCACGATAGCCAG NH2-3' | 3655 |
| | Invader | 5'-TGCATCCTTCACATGTCATGACATTGAAGTC-3' | 3656 |
| | Stacker | 5'-tggccttgtccc-3' | 3657 |
| | Arrestor | 5'-ctggctatcgtgcgc-3' | 3658 |
| 1 | Probe | 5'-AACGAGGGCGCACGCAGTGTCT-3' | 3659 |
| | Invader | 5'-AAGTTGCTGGAAGCCACCTC-3' | 3660 |
| | Stacker | 5'-tccaagcagtaggaca-3' | 3661 |
| | Arrestor | 5'-agacactgcgtgcgc-3' | 3662 |
| 1 | Probe | 5'- AAC GAG GCG CAC CAT CCA GAG NH2-3' | 3663 |
| | Invader | 5'- CCT CCA AAA GGA AAC TGG AGG TAT ACT TTA -3' | 3664 |
| | Stacker | 5'- cct ctt tgg tac taa gc -3' | 3665 |
| | Arrestor | 5'- ctc tgg atg gtg cgc -3' | 3666 |
| 1 | Probe | 5'-AACGAGGCGCACCTTCTATTAGTGA NH2-3' | 3667 |
| | Invader | 5'-CAGATTCATGAAGAACCCTGTATCATTGATATCAA-3' | 3668 |
| | Stacker | 5'-tgtttgacatcagatcttctaaat-3' | 3669 |
| | Arrestor | 5'-tcactaatagaaggtgcgc-3' | 3670 |
| 1 | Probe | 5'-AACGAGGCGCACAATATCCTGTCC NH2-3' | 3671 |
| | Invader | 5'-CCCGTAGAAACCTTACATTATGGTCCTC-3' | 3672 |
| | Stacker | 5'-atcaacactgaccatccctctgt-3' | 3673 |
| | Arrestor | 5'-ggacaggatattgtgcgc-3' | 3674 | human ABCB1

FIG. 49A-23 h3A4

| | | | |
|---|---|---|---|
| 1 | Probe | 5'-AACGAGGGCGCACCATTTCCTGCTG NH2-3' | 3675 |
| | Invader | 5'-GATTCATCAGCTGCATTTCTAATTCAACTTA-3' | 3676 |
| | Stacker | 5'-tctgcattgtgacaagtttg-3' | 3677 |
| | Arrestor | 5'-cagcaggaaatggtgcgc-3' | 3678 |
| 2 | Probe | 5'-CCGTCACGCCTCCATCCAGAG NH2-3' | 3679 |
| | Invader | 5'-CCTCCAAAAGGAAACTGGAGGTATACTTTA-3' | 3680 |
| | Stacker | 5'-cctctttggtactaagc-3' | 3681 |
| | Arrestor | 5'-ctctggatggaggcg-3' | 3682 |
| 1 | Probe | 5'-AACGAGGCGCACCTTTCAAGGTG NH2-3' | 3683 |
| | Invader | 5'-CTGTAGGCCCCAAAGACGTA-3' | 3684 |
| | Stacker | 5'-acaggctgcctgt-3' | 3685 |
| | Arrestor | 5'-caccttgaaaggtgcgcctcgtt-3' | 3686 |
| 1 | Probe | 5'-AACGAGGCGCACTTCACTCCAAAT NH2-3' | 3687 |
| | Invader | 5'-TCTTGTGTGGATTGTTGAGAGAGTCGATGA-3' | 3688 |
| | Stacker | 5'-gatgtgctagtgatcacatc-3' | 3689 |
| | Arrestor | 5'-atttggagtgaagtgcgcctcgtt-3' | 3690 |
| 1 | Probe | 5'-AACGAGGCGCACTCACTCCAAAT NH2-3' | 3691 |
| | Invader | 5'-TTGTGTGGATTGTTGAGAGAGTCGATGTA-3' | 3692 |
| | Stacker | 5'-gatgtgctagtgatcacatc-3' | 3693 |
| | Arrestor | 5'-atttggagtgagtgcgcctcgtt-3' | 3694 |
| 1 | Probe | 5'-AACGAGGGCGCACCATAATGAAGGAGAG NH2-3' | 3695 |
| | Invader | 5'-GGGTGAGTGGCCAGTTCATAA-3' | 3696 |
| | Stacker | 5'-aacactgctcggttt-3' | 3697 |
| | Arrestor | 5'-ctctccttcattatggtgcgc-3' | 3698 |

FIG. 49A-24 h3A7

| | | | |
|---|---|---|---|
| 1 | Probe | 5'-AACGAGGCGCAGATAATGAAGGAGAG NH2-3' | 3699 |
| | Invader | 5'-GGTGAGTGGCCTGTTCATACC-3' | 3700 |
| | Stacker | 5'-aacactgctggtt-3' | 3701 |
| | Arrestor | 5'-ctctccttcattattcgc-3' | 3702 |
| 1 | Probe | 5'-AACGAGGGCGCACGAGAGCAAACCT NH2-3' | 3703 |
| | Invader | 5'-ACTCTGATTAGAGCAAGTTTCATGTTCATC-3' | 3704 |
| | Stacker | 5'-catgccaatgcagttct-3' | 3705 |
| | Arrestor | 5'-aggtttgctctgtgcgc-3' | 3706 |
| 1 | Probe | 5'-AACGAGGCGCACGTTTCAAGGTG NH2-3' | 3707 |
| | Invader | 5'-CTGTAGGCCCCAAAGACGTC-3' | 3708 |
| | Stacker | 5'-acaggcttgcctgt-3' | 3709 |
| | Arrestor | 5'-cacctgaaacgtgcgcctcgtt-3' | 3710 |
| 1 | Probe | 5'-AACGAGGGCGCACTTTCAAGGTG NH2-3' | 3711 |
| | Invader | 5'-CTGTAGGCCCCAAAGACGTGA-3' | 3712 |
| | Stacker | 5'-acaggcttgcctgt-3' | 3713 |
| | Arrestor | 5'-cacctgaaagtgcgcctcgtt-3' | 3714 |
| 1 | Probe | 5'-AACGAGGCGCACCTCACTCCAAAT NH2-3' | 3715 |
| | Invader | 5'-TCTTGTGTGGATTGTTGAGAGAGTCGATGA-3' | 3716 |
| | Stacker | 5'-gatgtgctagtgatcacatc-3' | 3717 |
| | Arrestor | 5'-atttggagtgaggtgcgcctcgtt-3' | 3718 |
| 1 | Probe | 5'-AACGAGGGCGCACTATAATGAAGGAGAG NH2-3' | 3719 |
| | Invader | 5'-GGGTGAGTGGCCAGTTCATAA-3' | 3720 |
| | Stacker | 5'-aacactgctggtt-3' | 3721 |
| | Arrestor | 5'-ctctccttcattatagtcgc-3' | 3722 |

FIG. 49A-25

| | | Sequence | SEQ ID |
|---|---|---|---|
| 1 | Probe | 5'-AACGAGGCGCAGATAATGAAGGAGAG NH2-3' | 3723 |
| | Invader | 5'-GGGTGAGTGCCAGTTCATATC-3' | 3724 |
| | Stacker | 5'-aacactgctcgtggtt-3' | 3725 |
| | Arrestor | 5'-ctctccttcattatctgcgc-3' | 3726 |
| 1 | Probe | 5'-AACGAGGCGCACCGAGAGCAAACC NH2-3' | 3727 |
| | Invader | 5'-TCTGACTAGAGCAAGTTTCATGTTCAA-3' | 3728 |
| | Stacker | 5'-tcatgccaatgcagttc-3' | 3729 |
| | Arrestor | 5'-ggtttgctctcggtgcgc-3' | 3730 |
| 1 | Probe | 5'-AACGAGGCGCAGGAGAGCAAACCT NH2-3' | 3731 |
| | Invader | 5'-TCTGACTAGAGCAAGTTTCATGTTCACC-3' | 3732 |
| | Stacker | 5'-catgccaatgcagtttct-3' | 3733 |
| | Arrestor | 5'-aggtttcgtctcctgcgc-3' | 3734 |
| rat SLC10A1 | | | |
| 1 | Probe | 5'-AACGAGGCGCACAGCATGATAAGCA NH2-3' | 3735 |
| | Arrestor | 5'-tgcttatcatgctgtgcgc-3' | 3736 |
| 2 | Probe | 5'-CCGTCACGCCTCAGCATGATAAGCA NH2-3' | 3737 |
| | Arrestor | 5'-tgcttatcatgctgaggcg-3' | 3738 |
| | Invader | 5'-GGTGCAGCCCAGTGAGC-3' | 3739 |
| | Stacker | 5'-gcaacattaacaccaggatgat-3' | 3740 |
| human CD36 | | | |
| 1 | Probe | 5'-AACGAGGCGCACGGAGGTGAATTAG NH2-3' | 3741 |
| | Arrestor | 5'-ctaattcacctccgtgcgc-3' | 3742 |
| 2 | Probe | 5'-CCGTCACGCCTCGGAGGTGAATTAG NH2-3' | 3743 |
| | Arrestor | 5'-ctaattcacctccgaggcg-3' | 3744 |
| | Invader | 5'-TCACAGCCCATTTTCTTGTTCAC-3' | 3745 |
| | Stacker | 5'-tgtttaagcacctgtttct-3' | 3746 |
| 1 | Probe | 5'-AACGAGGCGCACGGAGGTGAATTA NH2-3' | 3747 |
| | Arrestor | 5'-taattcacctccgtgcgc-'3 | 3748 |
| 2 | Probe | 5'-CCGTCACGCCTCGGAGGTGAATTA NH2-3' | 3749 |
| | Arrestor | 5'-taattcacctccgaggcg-3' | 3750 |
| | Invader | 5'-TCACAGCCCATTTTCTTGTTCAC-3' | 3751 |
| | Stacker | 5'-gtgttaagcacctgttc-3' | 3752 |

FIG. 49A-26 human SLC21A6

| | | Sequence | SEQ ID |
|---|---|---|---|
| 1 | Probe | 5'-AACGAGGCGCACGACAGATTCCTTT NH2-3' | 3753 |
| | Arrestor | 5'-aaaggaatctgtcgtgcgc-3' | 3754 |
| 2 | Probe | 5'-CCGTCACGCCTCGACAGATTCCTTT NH2-3' | 3755 |
| | Arrestor | 5'-aaaggaatctgtcgaggcg-3' | 3756 |
| | Invader | 5'-ATGTCGCAGTGACTTTCCCAATAGC-3' | 3757 |
| | Stacker | 5'-taccttatatgtcgattatgg-3' | 3758 |
| 1 | Probe | 5'-AACGAGGCGCACGGTTTTCAACTG NH2-3' | 3759 |
| | Arrestor | 5'-cagttgaaaccgtgcgc-3' | 3760 |
| 2 | Probe | 5'-CCGTCACGCCTCGGTTTTCAACTG NH2-3' | 3761 |
| | Arrestor | 5'-cagttgaaaaccgaggcg-3' | 3762 |
| | Invader | 5'-TCTGTGCAGAAACAATAGTTGTCTGC-3' | 3763 |
| | Stacker | 5'-gagaggcaaaggcct-3' | 3764 |
| 1 | Probe | 5'-AACGAGGCGCACCGTATTTGAAGACATAAG NH2-3' | 3765 |
| | Invader | 5'-GGCTGACCATACTGTTGCTCTAA-3' | 3766 |
| | Stacker | 5'-taaaagcaccaaatagctgct-3' | 3767 |
| | Arrestor | 5'-cttatgtcttcaaatacggtgcgc-'3 | 3768 |
| 1 | Probe | 5'-AACGAGGCGCACCAGCAGTAAAACAT NH2-3' | 3769 |
| | Invader | 5'-aggtaaaaggACAATGACATCAA-3' | 3770 |
| | Stacker | 5'-gagaatttggcaattccaacg-3' | 3771 |
| | Arrestor | 5'-atgttttactgctggtgcgc-3' | 3772 | human SLC21A8

| | | Sequence | SEQ ID |
|---|---|---|---|
| 1 | Probe | 5'-AACGAGGCGCACCTACATATCCAATATC NH2-3' | 3773 |
| | Invader | 5'-CTTAGGAGTTATTCTGATAGTGCTCAGATA-3' | 3774 |
| | Stacker | 5'-cacgtacattttagcaaacagagat-3' | 3775 |
| | Arrestor | 5'-gatattggatatgtaggtgcgc-3' | 3776 |
| 1 | Probe | 5'-AACGAGGCGCACCAAGAAGGATATCATC NH2-3' | 3777 |
| | Invader | 5'-cagattagagggaaaTATAGAAGTTGAAAA-3' | 3778 |
| | Stacker | 5'-gaagtaagaaatgaaaattggcaattcc-3' | 3779 |
| | Arrestor | 5'-gatgatatccttcttggtgcgc-3' | 3780 |

FIG. 49A-27

| | | | | |
|---|---|---|---|---|
| | 1 | Probe | 5'-AACGAGGGCGCACTAAATGTGGTACCT NH2-3' | 3781 |
| | | Invader | 5'-CAGGTTGAACAATCTTCACAGTCAACAAGAA-3' | 3782 |
| | | Stacker | 5'-cctgttgcagagaacaaaga-3' | 3783 |
| | | Arrestor | 5'-aggtaccacatttagtgcgc-3' | 3784 |
| human SLC21A9 | 1 | Probe | 5'-AACGAGGGCCACGCTGTTGTC NH2-3' | 3785 |
| | | Invader | 5'-GCTGCAGTTGGTGTAGAAAACCTGC-3' | 3786 |
| | | Stacker | 5'-cagagcatcctggac-3' | 3787 |
| | | Arrestor | 5'-gacaaacagcgtgcgc-3' | 3788 |
| | 1 | Probe | 5'-AACGAGGCGCACCCAAAATCCTCA NH2-3' | 3789 |
| | | Invader | 5'-GGCTGGGCATCCAGGA-3' | 3790 |
| | | Stacker | 5'-ggaacatgaactggatgcc-3' | 3791 |
| | | Arrestor | 5'-tgaggatttggtgcgc-3' | 3792 |
| | 1 | Probe | 5'-CCGTCACGCCTCGCTAAGGCTC NH2-3' | 3793 |
| | | Invader | 5'-GTTCATTCCTACCTGACAGGAGATGC-3' | 3794 |
| | | Stacker | 5'-aaagaaggtgatccaggc-3' | 3795 |
| | | Arrestor | 5'-gagccttagcgaggcg-3' | 3796 |
| human SULT Pan 1A | 1 | Probe | 5'-AACGAGGCGCACCCTTGACCTTC NH2-3' | 3797 |
| | | Arrestor | 5'-gaaggtcaagggtgcgc-3' | 3798 |
| | 2 | Probe | 5'-CCGTCACGCCTCCCTTGACCTTC NH2-3' | 3799 |
| | | Arrestor | 5'-gaaggtcaagggaggcg-3' | 3800 |
| | | Invader | 5'-TTGCGTTGCGGGCAACATAGACCAA-3' | 3801 |
| | | Invader | 5'-TTGCGTTTCGGGCAACATAGACCAA-3' | 3802 |
| | | Stacker | 5'-tgatcaacagagtctgg-3' | 3803 |
| | 1 | Probe | 5'-AACGAGGCGCACCCGCATCGAAG NH2-3' | 3804 |
| | | Arrestor | 5'-cttcgatgcgggtgcgc-3' | 3805 |
| | 2 | Probe | 5'-CCGTCACGCCTCCCGCATCGAAG NH2-3' | 3806 |
| | | Arrestor | 5'-cttcgatgcgggaggcg-3' | 3807 |
| | | Invader | 5'-CTGCCATCTCTCGCATAGTA-3' | 3808 |
| | | Stacker | 5'-cgctcattctgcgc-3' | 3809 |

FIG. 49A-28 human UGT Pan 1A

| | | | | |
|---|---|---|---|---|
| 1 | Probe | 5'-AACGAGGCGCACCCGCATAGTC NH2-3' | | 3810 |
| | Arrestor | 5'-gactatgcggtgcgc-3' | | 3811 |
| 2 | Probe | 5'-CCGTCACGCCTCCCGCATAGTC NH2-3' | | 3812 |
| | Arrestor | 5'-gactatgcggaggcg-3' | | 3813 |
| | Invader | 5'-TGCAGCCTGCCATCTTCTA-3' | | 3814 |
| | Stacker | 5'-cgcatcgaagcgctca-3' | | 3815 |
| 1 | Probe | 5'-AACGAGGCGCACCAATTGCCATAGC NH2-3' | | 3816 |
| | Arrestor | 5'-gctatggcaattggtgcgc-3' | | 3817 |
| 2 | Probe | 5'-CCGTCACGCCTCCAATTGCCATAGC NH2-3' | | 3818 |
| | Arrestor | 5'-gctatggcaattggaggcg-3' | | 3819 |
| | Invader | 5'-GAGGGATTTGCCCAAAGCATCAGA-3' | | 3820 |
| | Stacker | 5'-tttcttctctggaatttctg-3' | | 3821 |
| 1 | Probe | 5'-AACGAGGCGCACCGCTTTGCATT NH2-3' | | 3822 |
| | Arrestor | 5'-aatgcaaagcggtgcgc-3' | | 3823 |
| 2 | Probe | 5'-CCGTCACGCCTCCGCTTTGCATT NH2-3' | | 3824 |
| | Arrestor | 5'-aatgcaaagcggaggcg-3' | | 3825 |
| | Invader | 5'-CAGCTCCCTTAGTCTCCATGA-3' | | 3826 |
| | Stacker | 5'-gtccatctgatcaccaaac-3' | | 3827 |
| 1 | Probe | 5'-AACGAGGCGCACCGACGGCCAA NH2-3' | | 3828 |
| | Arrestor | 5'-ttgccgtcggtgcgc-3' | | 3829 |
| 2 | Probe | 5'-CCGTCACGCCTCCGACGGCCAA NH2-3' | | 3830 |
| | Arrestor | 5'-ttgccgtcggaggcg-3' | | 3831 |
| | Invader | 5'-GTGATGAAGGCCACTGTCAGCAA-3' | | 3832 |
| | Stacker | 5'-gaggaaccaatcacgtcc-3' | | 3833 |

FIG. 49A-29

| | | Oligo Sequence (5' to 3') | SEQ ID NO |
|---|---|---|---|
| Secondary system | | | |
| FRET probe | | FL-CAC-Z28-TGC TTC GTG G | 3834 |
| Secondary Reaction Template 1 | | CCA GGA AGC AAG TGG TGC GCC TCG ttt | 3835 |
| Secondary Reaction Template 2 | | CCA GGA AGC AAG TGG AGG CGT GAC ggt | 3836 |
| Secondary Reaction Template 3 | | CCA GGA AGC AAG TGA CGC AGC GAC ggt | 3837 |

| Assays | SRT # | Oligo Type | Oligo Sequence (5' to 3') | SEQ ID NO |
|---|---|---|---|---|
| hCEACAM5 | 1 | Probe | AACGAGGCGCACTGTGAGCAGGA-NH$_2$ | 3838 |
| | | Invader | GGTTCCAGAAGGTTAGAAGTGAGGCA | 3839 |
| | | Stacker | gcctctgccagg | 3840 |
| | | Arrestor | tcctgctcacagtgcgc | 3841 |
| hCEACAM5 | 1 | Probe | AACGAGGGCGCACAATCACTGCGCC-NH$_2$ | 3842 |
| | | Invader | CCATAGAGGACATTCAGGATGACTGC | 3843 |
| | | Stacker | tggcactcactggg | 3844 |
| | | Arrestor | tcctgctcacagtgcgc | 3845 |
| hCEACAM5 | 1 | Probe | AACGAGGGCGCACAATCACTGCGC-NH$_2$ | 3846 |
| | | Stacker | ctggcactcactgg | 3847 |
| | | Arrestor | gcgcagtgattgtgcgc | 3848 |
| hCEACAM5 | 2 | Probe | CCGTCACGCCTCCTTGCTGTGT-NH$_2$ | 3849 |
| | | Invader | GGTTCTGGGTTTCACATTTGTAGA | 3850 |
| | | Stacker | catttctgtgacattgaatagagt | 3851 |
| | | Arrestor | acacagcaaggaggcgc | 3852 |
| hCEACAM5 | 1 | Probe | AACGAGGCGCACCACTGAGTAGA-NH$_2$ | 3853 |
| | | Invader | GGTCCTACATCATTCCTTGTGAA | 3854 |
| | | Stacker | gtgagggtcctgtt | 3855 |
| | | Arrestor | tctactcagtgtgcgc | 3856 |

FIG. 49A-30

| Gene | Type | Sequence | ID |
|---|---|---|---|
| hCEACAM5 | 1 Probe | AACGAGGCGCACTTGCTGGAT-NH₂ | 3857 |
| | Invader | TTGGAGATAAAGAGCTCTTGTGTGTGA | 3858 |
| | Stacker | gttccatcaatcaga | 3859 |
| | Arrestor | atccagcaagtgcgc | 3860 |
| hNOS2A | 2 Probe | CCGTCACGCCCTCGTTTCTATCTCCTTTGT-NH₂ | 3861 |
| | Invader | CGTCAGTTGGTCGGTTCCTGTTC | 3862 |
| | Arrestor | acaaaggagatagaaacgaggcg | 3863 |
| hNOS2A | 2 Probe | CCGTCACGCCCTCGTTTCTATCTC-NH₂ | 3864 |
| | Invader | CGTCAGTTGGTCGGTTCCTGTTC | 3865 |
| | Stacker | ctttgttaccgcttcc | 3866 |
| | Arrestor | gagatagaaacgaggcg | 3867 |
| hOSM | 1 Probe | AACGCGGCGCACTGTTGTTCCT-NH₂ | 3868 |
| | Invader | GCTGGGCCATGCAGTAGAA | 3869 |
| | Stacker | gagcccgaggatgt | 3870 |
| | Arrestor | aggaacaacagtgcgc | 3871 |
| hOSM | 1 Probe | AACGAGGCGCACTGTTGTTCC-NH₂ | 3872 |
| | Stacker | tgagcccgaggatgt | 3873 |
| hOSM | 1 Probe | AACGAGGCGCACGTCTGAGTTGT-NH₂ | 3874 |
| | Invader | GTGGGCTCAGCCGTC | 3875 |
| | Stacker | ccagcagctggg | 3876 |
| | Arrestor | acaactcagacgtgcgc | 3877 |
| hICAM | 2 Probe | CCGTCACGCCCTCGGCTTGTGTGTTC-NH₂ | 3878 |
| | Invader | CCGGGATAGGTTCAGGGAGGCCGTC | 3879 |
| | Stacker | ggtttcatgggggtccct | 3880 |
| | Arrestor | gaacacacaagccgaggcg | 3881 |

FIG. 49A-31

| | | | |
|---|---|---|---|
| hICAM | 1 Probe | AACGAGGGCGCACGGCTTGTGT-NH$_2$ | 3882 |
| | Invader | GATAGGTTCAGGGAGGCGTC | 3883 |
| | Stacker | gttcggtttcatgggg | 3884 |
| | Arrestor | acacaagccgtgcgc | 3885 |
| hICAM | 1 Probe | AACGAGGCGCACGTATTTCTTGATCTTC-NH$_2$ | 3886 |
| | Invader | TTTTGGGCCTGTTGTAGTCTC | 3887 |
| | Stacker | cgctgcgttatagag | 3888 |
| | Arrestor | gaagatcaagaaatacgtgcgc | 3889 |
| hICAM | 1 Probe | AACGAGGCGCACACCATGGC-NH$_2$ | 3890 |
| | Invader | CTAGTGTTTAGGTGTGCAGGTC | 3891 |
| | Stacker | cccaaatgctgttgtatct | 3892 |
| | Arrestor | gccatggtgtgcgc | 3893 |
| hICAM | 1 Probe | AACGAGGCGCACACCATGGCC-NH$_2$ | 3894 |
| | Invader | CTAGTGTTTAGGTGTGCAGGTC | 3895 |
| | Stacker | cccaaatgctgttatctga | 3896 |
| | Arrestor | ggccatggtgtgcgc | 3897 |
| Neomycin | 1 Probe | AACGCGGGCCACGCCATTTTCCAC-NH$_2$ | 3898 |
| | Invader | CCACAGTCGATGAATCCAGAAAAGCGA | 3899 |
| | Stacker | catgatattcggcaagcag | 3900 |
| | Arrestor | tggaaaatggcgtgcgc | 3901 |
| Neomycin | 1 Probe | AACGCGGGCCACGCCATTTTCCA-NH$_2$ | 3902 |
| | Stacker | ccatgatattcggcaagcag | 3903 |

FIG. 49A-32

| | | | |
|---|---|---|---|
| Neomycin | 1 Probe | AACGAGGCGCACCAGTTCATTCAG-NH₂ | 3904 |
| | Invader | CGCTGCCTCGTCCTGA | 3905 |
| | Stacker | ggcaccggacagg | 3906 |
| | Arrestor | ctgaatgaactggtgcgc | 3907 |
| hMMP3 | 2 Probe | CCGTCACGCCTCGTCCATTGTTCA-NH₂ | 3908 |
| | Invader | TGGTCCCTGTTGTATCCTTTC | 3909 |
| | Stacker | tcatcatcaaagtgggca | 3910 |
| | Arrestor | tgaacaatggacgaggcg | 3911 |
| hMMP3 | 2 Probe | CCGTCACGCCTCGTCCATTGTTCAT-NH₂ | 3912 |
| | Stacker | catcatcaaagtgggcatc | 3913 |
| | Arrestor | atgaacaatggacgaggcg | 3914 |
| hMMP13 | 1 Probe | AACGAGGCGCACTCAAGGGATAAGGA-NH₂ | 3915 |
| | Invader | CCTCGGAGACTGGTAATGGCAA | 3916 |
| | Stacker | agggtcacattgtctg | 3917 |
| | Arrestor | tccttatcccttgagtgcgc | 3918 |
| hMMP13 | 2 Probe | CCGTCGCTGCGTTTCTTCCC-NH₂ | 3919 |
| | Invader | CAAGCTTTCTCCTGATAGCTCA | 3920 |
| | Stacker | ctacccgcacttc | 3921 |
| | Arrestor | gggaagaaacgcag | 3922 |
| hMMP13 | 2 Probe | CCGTCGCTGCGTTTCTTCCCC-NH₂ | 3923 |
| | Stacker | tacccgcacttct | 3924 |
| | Arrestor | ggggaagaaacgcag | 3925 |
| hMMP13 | 1 Probe | AACGAGGCGACGGCATCAAGG-NH₂ | 3926 |
| | Invader | GTTCTCCTCGGAGACTGGTAATC | 3927 |
| | Stacker | gataaggaaggtcacatttg | 3928 |
| | Arrestor | ccttgatgccgtgcgc | 3929 |

FIG. 49A-33

| Gene | Type | Sequence | SEQ ID |
|---|---|---|---|
| hMMP13 | 1 Probe | AACGAGGCGCACTCTTCTTCC-NH2 | 3930 |
| | Invader | GAACCAAGCTTTCTCCTGATAGCA | 3931 |
| | Stacker | cctacccgcact | 3932 |
| | Arrestor | ggaagaagtgcgc | 3933 |
| hLipc | 1 Probe | AACGAGGCGCACCTTTGTTCCGA-NH2 | 3934 |
| | Invader | AGAGTGATGGGAATTTCTGCATTTTCTA | 3935 |
| | Stacker | gtagtgacatggtaaagttgttt | 3936 |
| | Arrestor | tcggaacaaaagtgcgc | 3937 |
| hLipc | 1 Probe | AACGAGGCGCACCTTTGTTCCG-NH2 | 3938 |
| | Invader | AGAGTGATGGGAATTTCTGCATTTTCTA | 3939 |
| | Stacker | agtagtgacatggtaaagttgt | 3940 |
| | Arrestor | cggaacaaagtgcgc | 3941 |
| hLipc | 2 Probe | CCGTCACGCCCTCCTTTTGTTCCGA-NH2 | 3942 |
| | Stacker | gtagtgacatggtaaagttgttt | 3943 |
| | Arrestor | tcggaacaaaaggaggcg | 3944 |
| hLipc | 2 Probe | CCGTCACGCCCTCCTTTTGTTCCG-NH2 | 3945 |
| | Arrestor | cggaacaaaaggaggcg | 3946 |
| r/m Lipc | 2 Probe | CCGTCACGCCTCGGAGTCAAT-NH2 | 3947 |
| | Invader | GCAGGTTGCTGTGTTGCAAC | 3948 |
| | Stacker | gaagaggtgcacagaacg | 3949 |
| | Arrestor | attgactccgaggcg | 3950 |
| r/m Lipc | 1 Probe | AACGAGGCGCACTGATGGGAATTTTC-NH2 | 3951 |
| | Invader | GTAATTCCTTCGCCCAGGGA | 3952 |
| | Stacker | tttattctcttttgtccc | 3953 |
| | Arrestor | gaaaattccatcagtgcgc | 3954 |

FIG. 49A-34

| | | | |
|---|---|---|---|
| r/m Lipc | 1 Probe | AACGAGGCGCACTGCTTCTTCA-NH$_2$ | 3955 |
| | Invader | TCTCTTGACTCATCTGCTCTTTA | 3956 |
| | Stacker | gtcttttgacttcaggtc | 3957 |
| | Arrestor | tgaagaagcagtgcgc | 3958 |
| r/m Lipc | 1 Probe | AACGAGGCGCACTGCTTCTTCAGT-NH$_2$ | 3959 |
| | Invader | TCTCTTGACTCATCTGCTCTTTA | 3960 |
| | Stacker | cttttgacttcaggtcac | 3961 |
| | Arrestor | actgaagaagcagtgcgc | 3962 |
| hVCAM | 2 Probe | CCGTCACGCCTCGCCTTTGTTTG-NH$_2$ | 3963 |
| | Invader | GGGCAACATTGACATAAAGTGTTTGCGTACTCTC | 3964 |
| | Stacker | ggttcgaattccatgtcatc | 3965 |
| | Arrestor | caaacaaaggcgaggcg | 3966 |
| hVCAM | 1 Probe | AACGAGGCGCACATGTAATTTAGCT-NH$_2$ | 3967 |
| | Invader | GTGGGCACAGAATCCATTTCATCAC | 3968 |
| | Stacker | cggcaaacaagaacttttcca | 3969 |
| | Arrestor | agctaaattacacatgtgcgc | 3970 |
| hVCAM | 1 Probe | AACGAGGCGCACATGTAATTTAGCTC-NH$_2$ | 3971 |
| | Stacker | ggcaaacaagaacttttccaatat | 3972 |
| | Arrestor | gagctaaattacacatgtgcgc | 3973 |
| hVCAM | 1 Probe | AACGAGGCGCACGCCTTGTTTG-NH$_2$ | 3974 |
| | Invader | GCAACATTGACATAAAGTGTTTGCGTACTCTC | 3975 |
| | Stacker | ggttcgaattccatgtcat | 3976 |
| | Arrestor | caaacaaaggcgtgcgc | 3977 |
| hVCAM | 2 Probe | CCGTCACGCCTCGCCTTTGTTTG-NH$_2$ | 3978 |
| | Invader | GCAACATTGACATAAAGTGTTTGCGTACTCTC | 3979 |
| | Stacker | ggttcgaattccatgtcat | 3980 |
| | Arrestor | caaacaaaggcgaggcg | 3981 |

FIG. 49A-35

| | | | |
|---|---|---|---|
| hRPL19 | 1 Probe | AAGCAGGCGCACCTTCCTTGG-NH₂ | 3982 |
| | Invader | CTCTTCACGGCGCTTGCGTGA | 3983 |
| | Stacker | tcttagacctgcgagcc | 3984 |
| | Arrestor | ccaaggaaggtgcgc | 3985 |
| hRPL19 | 1 Probe | AACGAGGCGCACTGCTTCCTTG-NH₂ | 3986 |
| | Invader | GCTCTTCACGGCGCTTGCGA | 3987 |
| | Stacker | gtcttagacctgcgagcc | 3988 |
| | Arrestor | caaggaagcagtgcgc | 3989 |
| r/m RPL19 | 1 Probe | AAGCAGGGCCACCTTCCTTGG-NH₂ | 3990 |
| | Invader | CTCCCGGCGCTTTCGTGA | 3991 |
| | Stacker | tcttagacctgcgagcc | 3992 |
| | Arrestor | ccaaggaaggtgcgc | 3993 |
| r/m RPL19 | 1 Probe | AACGAGGCGCACTGCTTCCTTG-NH₂ | 3994 |
| | Invader | CCTCCCGGCGCTTTCGA | 3995 |
| | Stacker | gtcttagacctgcgagcc | 3996 |
| | Arrestor | caaggaagcagtgcgc | 3997 |
| h18S rRNA | Probe | Red-CGA-EQ-TTTTACTTCC | 3998 |
| | Probe | Red-CGA-EQ-TTTTACTTCCTCT | 3999 |
| | Probe | FI-CGACTTTACTTCCTCT | 4000 |
| | INVADER oligonucleotide | GGTTCACCTACGGAAACCTTGTTAa | 4001 |
| | Stacker | tctagatagtcaagttcgaccg | 4002 |
| | Stacker | tctagatagtcaagttcgaccgtcttctc | 4003 |
| | Arrestor | agaggaagtaaaattcg | 4004 |

RNA DETECTION ASSAYS

The present application is a continuation-in-part of U.S. patent application Ser. No. 09/864,636, filed May 24, 2001 now U.S. Pat. No. 7,045,289, and is a continuation-in-part of U.S. patent application Ser. No. 09/864,426, filed May 24, 2001, each of which is a continuation-in-part of U.S. patent application Ser. Nos. 09/577,304, filed May 24, 2000, which issued as U.S. Pat. No. 6,759,226 on Jul. 6, 2004, and 09/758,282, filed Jan. 11, 2001, which issued as U.S. Pat. No. 6,635,463 on Oct. 21, 2003, and is a continuation-in-part of U.S. patent application Ser. No. 09/350,309, filed Jul. 9, 1999, which issued as U.S. Pat. No. 6,348,314 on Feb. 19, 2002 and which is a divisional application of U.S. patent application Ser. No. 08/756,386, filed Nov. 26, 1996, which issued as U.S. Pat. No. 5,985,557 on Nov. 16, 1999, and is also a continuation-in-part of application Ser. No. 09/381,212, filed Feb. 8, 2000, which is a national entry of PCT Application No. US 98/05809 filed Mar. 24, 1998, which claims priority to U.S. patent application Ser. Nos. 08/823,516, filed Mar. 24, 1997, which issued as U.S. Pat. No. 5,994,069 on Nov. 30, 1999, 08/759,038, filed Dec. 2, 1996, which issued as U.S. Pat. No. 6,090,543 on Jul. 18, 2000, 08/756,386, filed Nov. 26, 1996, which issued as U.S. Pat. No. 5,985,557 on Nov. 16, 1999, 08/682,853, filed Jul. 12, 1996, which issued as U.S. Pat. No. 6,001,567 on Dec. 14, 1999, and 08/599,491, filed Jan. 24, 1996, which issued as U.S. Pat. No. 5,846,717 on Dec. 8, 1998, and PCT Application No. US 97/01072, filed on Jan. 21, 1997.

FIELD OF THE INVENTION

The present invention relates to compositions and methods for the detection and characterization of nucleic acid sequences and variations in nucleic acid sequences. The present invention relates to methods for forming a nucleic acid cleavage structure on a target sequence and cleaving the nucleic acid cleavage structure in a site-specific manner. For example, in some embodiments, the 5' nuclease activity of a variety of enzymes is used to cleave the target-dependent cleavage structure, thereby indicating the presence of specific nucleic acid sequences or specific variations thereof.

BACKGROUND OF THE INVENTION

Methods for the detection and characterization of specific nucleic acid sequences and sequence variations have been used to detect the presence of viral or bacterial nucleic acid sequences indicative of an infection, to detect the presence of variants or alleles of genes associated with disease and cancers. These methods also find application in the identification of sources of nucleic acids, as for forensic analysis or for paternity determinations.

Various methods are known to the art that may be used to detect and characterize specific nucleic acid sequences and sequence variants. Nonetheless, with the completion of the nucleic acid sequencing of the human genome, as well as the genomes of numerous pathogenic organisms, the demand for fast, reliable, cost-effective and user-friendly tests for the detection of specific nucleic acid sequences continues to grow. Importantly, these tests must be able to create a detectable signal from samples that contain very few copies of the sequence of interest. The following discussion examines two levels of nucleic acid detection assays currently in use: I. Signal Amplification Technology for detection of rare sequences II. Direct Detection Technology for quantitative detection of sequences, and III. Direct Detection of RNA.

I. Signal Amplification Technology Methods for Amplification

The "Polymerase Chain Reaction" (PCR) comprises the first generation of methods for nucleic acid amplification. However, several other methods have been developed that employ the same basis of specificity, but create signal by different amplification mechanisms. These methods include the "Ligase Chain Reaction" (LCR), "Self-Sustained Synthetic Reaction" (3SR/NASBA), and "Qβ-Replicase" (Qβ).

Polymerase Chain Reaction (PCR)

The polymerase chain reaction (PCR), as described in U.S. Pat. Nos. 4,683,195, 4,683,202, and 4,965,188 to Mullis and Mullis et al. (the disclosures of which are hereby incorporated by reference), describe a method for increasing the concentration of a segment of target sequence in a mixture of genomic DNA without cloning or purification. This technology provides one approach to the problems of low target sequence concentration. PCR can be used to directly increase the concentration of the target to an easily detectable level. This process for amplifying the target sequence involves introducing a molar excess of two oligonucleotide primers that are complementary to their respective strands of the double-stranded target sequence to the DNA mixture containing the desired target sequence. The mixture is denatured and then allowed to hybridize. Following hybridization, the primers are extended with polymerase so as to form complementary strands. The steps of denaturation, hybridization, and polymerase extension can be repeated as often as needed, in order to obtain relatively high concentrations of a segment of the desired target sequence.

The length of the segment of the desired target sequence is determined by the relative positions of the primers with respect to each other, and, therefore, this length is a controllable parameter. Because the desired segments of the target sequence become the dominant sequences (in terms of concentration) in the mixture, they are said to be "PCR-amplified."

Ligase Chain Reaction (LCR or LAR)

The ligase chain reaction (LCR; sometimes referred to as "Ligase Amplification Reaction" (LAR) described by Barany, Proc. Natl. Acad. Sci., 88:189 (1991); Barany, PCR Methods and Applic., 1:5 (1991); and Wu and Wallace, Genomics 4:560 (1989) has developed into a well-recognized alternative method for amplifying nucleic acids. In LCR, four oligonucleotides, two adjacent oligonucleotides that uniquely hybridize to one strand of target DNA, and a complementary set of adjacent oligonucleotides, that hybridize to the opposite strand are mixed and DNA ligase is added to the mixture. Provided that there is complete complementarity at the junction, ligase will covalently link each set of hybridized molecules. Importantly, in LCR, two probes are ligated together only when they base-pair with sequences in the target sample, without gaps or mismatches. Repeated cycles of denaturation, hybridization and ligation amplify a short segment of DNA. LCR has also been used in combination with PCR to achieve enhanced detection of single-base changes. Segev, PCT Public. No. WO9001069 A1 (1990). However, because the four oligonucleotides used in this assay can pair to form two short ligatable fragments, there is the potential for the generation of target-independent background signal. The use of LCR for mutant screening is limited to the examination of specific nucleic acid positions.

Self-Sustained Synthetic Reaction (3SR/NASBA) The self-sustained sequence replication reaction (3SR) (Guatelli et al., Proc. Natl. Acad. Sci., 87:1874–1878 [1990], with an erratum at Proc. Natl. Acad. Sci., 87:7797 [1990]) is a transcription-based in vitro amplification system (Kwok et al., Proc. Natl. Acad. Sci., 86:1173–1177 [1989]) that can exponentially amplify RNA sequences at a uniform temperature. The amplified RNA can then be utilized for mutation detection (Fahy et al., PCR Meth. Appl., 1:25 [1991]). In this method, an oligonucleotide primer is used to add a phage RNA polymerase promoter to the 5' end of the sequence of interest. In a cocktail of enzymes and substrates that includes a second primer, reverse transcriptase, RNase H, RNA polymerase and ribo-and deoxyribonucleoside triphosphates, the target sequence undergoes repeated rounds of transcription, cDNA synthesis and second-strand synthesis to amplify the area of interest. The use of 3SR to detect mutations is kinetically limited to screening small segments of DNA (e.g., 200–300 base pairs).

Q-Beta (Qβ) Replicase

In this method, a probe that recognizes the sequence of interest is attached to the replicatable RNA template for Qβ replicase. A previously identified major problem with false positives resulting from the replication of unhybridized probes has been addressed through use of a sequence-specific ligation step. However, available thermostable DNA ligases are not effective on this RNA substrate, so the ligation must be performed by T4 DNA ligase at low temperatures (37° C.). This prevents the use of high temperature as a means of achieving specificity as in the LCR, the ligation event can be used to detect a mutation at the junction site, but not elsewhere.

Table 2 below, lists some of the features desirable for systems useful in sensitive nucleic acid diagnostics, and summarizes the abilities of each of the major amplification methods (See also, Landgren, Trends in Genetics 9:199 [1993]).

A successful diagnostic method must be very specific. A straight-forward method of controlling the specificity of nucleic acid hybridization is by controlling the temperature of the reaction. While the 3SR/NASBA, and Qβ systems are all able to generate a large quantity of signal, one or more of the enzymes involved in each cannot be used at high temperature (i.e., >55° C.). Therefore the reaction temperatures cannot be raised to prevent non-specific hybridization of the probes. If probes are shortened in order to make them melt more easily at low temperatures, the likelihood of having more than one perfect match in a complex genome increases. For these reasons, PCR and LCR currently dominate the research field in detection technologies.

TABLE 1

| Feature | Method | | | | |
|---|---|---|---|---|---|
| | PCR | LCR | PCR & LCR | 3SR NASBA | Qβ |
| Amplifies Target | + | + | + | + | |
| Recognition of Independent Sequences Required | + | + | + | + | + |
| Performed at High Temp. | + | + | | | |
| Operates at Fixed Temp. | | | | + | + |
| Exponential Amplification | + | + | + | + | + |
| Generic Signal Generation | | | | | + |
| Easily Automatable | | | | | |

The basis of the amplification procedure in the PCR and LCR is the fact that the products of one cycle become usable templates in all subsequent cycles, consequently doubling the population with each cycle. The final yield of any such doubling system can be expressed as: $(1+X)^n=y$, where "X" is the mean efficiency (percent copied in each cycle), "n" is the number of cycles, and "y" is the overall efficiency, or yield of the reaction (Mullis, PCR Methods Applic., 1:1 [1991]). If every copy of a target DNA is utilized as a template in every cycle of a polymerase chain reaction, then the mean efficiency is 100%. If 20 cycles of PCR are performed, then the yield will be $2^{20}$, or 1,048,576 copies of the starting material. If the reaction conditions reduce the mean efficiency to 85%, then the yield in those 20 cycles will be only $1.85^{20}$, or 220,513 copies of the starting material. In other words, a PCR running at 85% efficiency will yield only 21% as much final product, compared to a reaction running at 100% efficiency. A reaction that is reduced to 50% mean efficiency will yield less than 1% of the possible product.

In practice, routine polymerase chain reactions rarely achieve the theoretical maximum yield, and PCRs are usually run for more than 20 cycles to compensate for the lower yield. At 50% mean efficiency, it would take 34 cycles to achieve the million-fold amplification theoretically possible in 20, and at lower efficiencies, the number of cycles required becomes prohibitive. In addition, any background products that amplify with a better mean efficiency than the intended target will become the dominant products.

Also, many variables can influence the mean efficiency of PCR, including target DNA length and secondary structure, primer length and design, primer and dNTP concentrations, and buffer composition, to name but a few. Contamination of the reaction with exogenous DNA (e.g., DNA spilled onto lab surfaces) or cross-contamination is also a major consideration. Reaction conditions must be carefully optimized for each different primer pair and target sequence, and the process can take days, even for an experienced investigator. The laboriousness of this process, including numerous technical considerations and other factors, presents a significant drawback to using PCR in the clinical setting. Indeed, PCR has yet to penetrate the clinical market in a significant way. The same concerns arise with LCR, as LCR must also be optimized to use different oligonucleotide sequences for each target sequence. In addition, both methods require expensive equipment, capable of precise temperature cycling.

Many applications of nucleic acid detection technologies, such as in studies of allelic variation, involve not only detection of a specific sequence in a complex background, but also the discrimination between sequences with few, or single, nucleotide differences. One method for the detection of allele-specific variants by PCR is based upon the fact that it is difficult for Taq polymerase to synthesize a DNA strand when there is a mismatch between the template strand and the 3' end of the primer. An allele-specific variant may be detected by the use of a primer that is perfectly matched with only one of the possible alleles; the mismatch to the other allele acts to prevent the extension of the primer, thereby preventing the amplification of that sequence. This method has a substantial limitation in that the base composition of the mismatch influences the ability to prevent extension across the mismatch, and certain mismatches do not prevent extension or have only a minimal effect (Kwok et al, Nucl. Acids Res., 18:999 [1990]).

A similar 3'-mismatch strategy is used with greater effect to prevent ligation in the LCR (Barany, PCR Meth. Applic., 1:5 [1991]). Any mismatch effectively blocks the action of the thermostable ligase, but LCR still has the drawback of target-independent background ligation products initiating the amplification. Moreover, the combination of PCR with subsequent LCR to identify the nucleotides at individual positions is also a clearly cumbersome proposition for the clinical laboratory.

II. Direct Detection Technology

When a sufficient amount of a nucleic acid to be detected is available, there are advantages to detecting that sequence directly, instead of making more copies of that target, (e.g., as in PCR and LCR). Most notably, a method that does not amplify the signal exponentially is more amenable to quantitative analysis. Even if the signal is enhanced by attaching multiple dyes to a single oligonucleotide, the correlation between the final signal intensity and amount of target is direct. Such a system has an additional advantage that the products of the reaction will not themselves promote further reaction, so contamination of lab surfaces by the products is not as much of a concern. Traditional methods of direct detection including Northern and Southern blotting and RNase protection assays usually require the use of radioactivity and are not amenable to automation. Recently devised techniques have sought to eliminate the use of radioactivity and/or improve the sensitivity in automatable formats. Two examples are the "Cycling Probe Reaction" (CPR), and "Branched DNA" (bDNA)

The cycling probe reaction (CPR) (Duck et al., BioTech., 9:142 [1990]), uses a long chimeric oligonucleotide in which a central portion is made of RNA while the two termini are made of DNA. Hybridization of the probe to a target DNA and exposure to a thermostable RNase H causes the RNA portion to be digested. This destabilizes the remaining DNA portions of the duplex, releasing the remainder of the probe from the target DNA and allowing another probe molecule to repeat the process. The signal, in the form of cleaved probe molecules, accumulates at a linear rate. While the repeating process increases the signal, the RNA portion of the oligonucleotide is vulnerable to RNases that may be carried through sample preparation.

Branched DNA (bDNA), described by Urdea et al., Gene 61:253–264 (1987), involves oligonucleotides with branched structures that allow each individual oligonucleotide to carry 35 to 40 labels (e.g., alkaline phosphatase enzymes). While this enhances the signal from a hybridization event, signal from non-specific binding is similarly increased.

While both of these methods have the advantages of direct detection discussed above, neither the CPR or bDNA methods can make use of the specificity allowed by the requirement of independent recognition by two or more probe (oligonucleotide) sequences, as is common in the signal amplification methods described in Section I. above. The requirement that two oligonucleotides must hybridize to a target nucleic acid in order for a detectable signal to be generated confers an extra measure of stringency on any detection assay. Requiring two oligonucleotides to bind to a target nucleic acid reduces the chance that false "positive" results will be produced due to the non-specific binding of a probe to the target. The further requirement that the two oligonucleotides must bind in a specific orientation relative to the target, as is required in PCR, where oligonucleotides must be oppositely but appropriately oriented such that the DNA polymerase can bridge the gap between the two oligonucleotides in both directions, further enhances specificity of the detection reaction. However, it is well known to those in the art that even though PCR utilizes two oligonucleotide probes (termed primers) "non-specific" amplification (i.e., amplification of sequences not directed by the two primers used) is a common artifact. This is in part because the DNA polymerase used in PCR can accommodate very large distances, measured in nucleotides, between the oligonucleotides and thus there is a large window in which non-specific binding of an oligonucleotide can lead to exponential amplification of inappropriate product. The LCR, in contrast, cannot proceed unless the oligonucleotides used are bound to the target adjacent to each other and so the full benefit of the dual oligonucleotide hybridization is realized.

An ideal direct detection method would combine the advantages of the direct detection assays (e.g., easy quantification and minimal risk of carry-over contamination) with the specificity provided by a dual oligonucleotide hybridization assay.

III. Direct Detection of RNA

In molecular medicine, a simple and cost-effective method for direct and quantitative RNA detection would greatly facilitate the analysis of RNA viruses and the measurement of specific gene expression. Both of these issues are currently pressing problems in the field. Despite this need, few techniques have emerged that are truly direct. PCR-based detection assays require conversion of RNA to DNA by reverse transcriptase before amplification, introducing a variable that can compromise accurate quantification. Furthermore, PCR and other methods based on exponential amplification (e.g., NASBA) require painstaking containment measures to avoid cross-contamination, and have difficulty distinguishing small differences (e.g., 2 to 3-fold) in quantity. Other tests that directly examine RNA suffer from a variety of drawbacks, including time consuming autoradiography steps (e.g., RNase protection assays), or overnight reaction times (e.g., branched DNA assays). With over 1.5 million viral load measurements being performed in the U.S. every year, there is clearly an enormous potential for an inexpensive, rapid, high-throughput system for the quantitative measurement of RNA.

Techniques for direct, quantitative detection of mRNA are vital for monitoring expression of a number of different genes. In particular, levels of cytokine expression (e.g., interleukins and lymphokines) are being exploited as clinical measures of immune response in the progression of a wide variety of diseases (Van Deuren et al., J. Int. Fed. Clin. Chem., 5:216 [1993], Van Deuren et al., J. Inf. Dis., 169:157 [1994], Perenboom et al., Eur. J. Clin. Invest., 26:159 [1996], Guidotti et al., Immunity 4:25 [1996]) as well as in monitoring transplant recipients (Grant et al., Transplantation 62:910 [1996]). Additionally, the monitoring of viral load and identification of viral genotype have great clinical significance for individuals suffering viral infections by such pathogens as HIV or Hepatitis C virus (HCV). There is a high correlation between viral load (i.e., the absolute number of viral particles in the bloodstream) and time to progression to AIDS (Mellors et al., Science 272:1167 [1996], Saag et al., Nature Medicine 2:625 [1996]). For that reason, viral load, as measured by quantitative nucleic acid based testing, is becoming a standard monitoring procedure for evaluating the efficacy of treatment and the clinical status of HIV positive patients. It is thought to be essential to reduce viral load as early in the course of infection as possible and to evaluate viral levels on a regular basis. In the case of HCV, viral genotype has great clinical significance, with correlations to severity of liver disease and responsiveness to interferon therapy. Furthermore, because HCV cannot be grown in culture, it is only by establishing correlations between characteristics like viral genotype and clinical outcome that new antiviral treatments can be evaluated.

While the above mentioned methods have been serviceable for low throughput, research applications, or for limited clinical application, it is clear that large scale quantitative analysis of RNA readily adaptable to any genetic system will require a more innovative approach. An ideal direct detection method would combine the advantages of the direct detection assays (e.g., easy quantification and minimal risk of carry-over contamination) with the specificity provided by a dual oligonucleotide hybridization assay.

Many of the methods described above rely on hybridization alone to distinguish a target molecule from other nucleic acids. Although some of these methods can be highly sensitive, they often cannot quantitate and distinguish closely related mRNAs accurately, especially such RNAs expressed at different levels in the same sample. While the above-mentioned methods are serviceable for some purposes, a need exists for a technology that is particularly adept at distinguishing particular RNAs from closely related molecules.

SUMMARY OF THE INVENTION

The present invention relates to compositions and methods for the detection and characterization of nucleic acid sequences and variations in nucleic acid sequences. The present invention relates to methods for forming a nucleic acid cleavage structure on a target sequence and cleaving the nucleic acid cleavage structure in a site-specific manner. For example, in some embodiments, the 5' nuclease activity of a variety of enzymes is used to cleave the target-dependent cleavage structure, thereby indicating the presence of specific nucleic acid sequences or specific variations thereof.

The present invention provides structure-specific cleavage agents (e.g., nucleases) from a variety of sources, including mesophilic, psychrophilic, thermophilic, and hyperthermophilic organisms. The preferred structure-specific nucleases are thermostable. Thermostable structure-specific nucleases are contemplated as particularly useful in that they operate at temperatures where nucleic acid hybridization is extremely specific, allowing for allele-specific detection (including single-base mismatches). In one embodiment, the thermostable structure-specific nucleases are thermostable 5' nucleases comprising altered polymerases derived from the native polymerases of *Thermus* species, including, but not limited to *Thermus aquaticus*, *Thermus flavus*, and *Thermus thermophilus*. However, the invention is not limited to the use of thermostable 5' nucleases. Thermostable structure-specific nucleases from the FEN-1, RAD2 and XPG class of nucleases are also preferred.

The present invention provides a method for detecting a target sequence (e.g., a mutation, polymorphism, etc.), comprising providing a sample suspected of containing the target sequence; oligonucleotides capable of forming an invasive cleavage structure in the presence of the target sequence; and an agent for detecting the presence of an invasive cleavage structure; and exposing the sample to the oligonucleotides and the agent. In some embodiments, the method further comprises the step of detecting a complex comprising the agent and the invasive cleavage structure (directly or indirectly). In some embodiments, the agent comprises a cleavage agent. In some preferred embodiments, the exposing of the sample to the oligonucleotides and the agent comprises exposing the sample to the oligonucleotides and the agent under conditions wherein an invasive cleavage structure is formed between the target sequence and the oligonucleotides if the target sequence is present in the sample, wherein the invasive cleavage structure is cleaved by the cleavage agent to form a cleavage product. In some embodiments, the method further comprises the step of detecting the cleavage product. In some embodiments, the target sequence comprises a first region and a second region, the second region downstream of and contiguous to the first region, and wherein the oligonucleotides comprise first and second oligonucleotides, wherein at least a portion of the first oligonucleotide is completely complementary to the first portion of the target sequence and wherein the second oligonucleotide comprises a 3' portion and a 5' portion, wherein the 5' portion is completely complementary to the second portion of said target nucleic acid.

The present invention also provides a kit for detecting such target sequences, said kit comprising oligonucleotides capable of forming an invasive cleavage structure in the presence of the target sequence. In some embodiments, the kit further comprises an agent for detecting the presence of an invasive cleavage structure (e.g., a cleavage agent). In some embodiments, the oligonucleotides comprise first and second oligonucleotides, said first oligonucleotide comprising a 5' portion complementary to a first region of the target nucleic acid and said second oligonucleotide comprising a 3' portion and a 5' portion, said 5' portion complementary to a second region of the target nucleic acid downstream of and contiguous to the first portion. In some preferred embodiments, the target sequence comprises The present invention also provides methods for detecting the presence of a target nucleic acid molecule by detecting non-target cleavage products comprising providing: a cleavage agent; a source of target nucleic acid, the target nucleic acid comprising a first region and a second region, the second region downstream of and contiguous to the first region; a first oligonucleotide, wherein at least a portion of the first oligonucleotide is completely complementary to the first portion of the target nucleic acid; and a second oligonucleotide comprising a 3' portion and a 5' portion, wherein the 5' portion is completely complementary to the second portion of the target nucleic acid; mixing the cleavage agent, the target nucleic acid, the first oligonucleotide and the second oligonucleotide to create a reaction mixture under reaction conditions such that at least the portion of the first oligonucleotide is annealed to the first region of said target nucleic acid and wherein at least the 5' portion of the second oligonucleotide is annealed to the second region of the target nucleic acid so as to create a cleavage structure, and wherein cleavage of the cleavage structure occurs to generate non-target cleavage product; and detecting the cleavage of the cleavage structure.

The detection of the cleavage of the cleavage structure can be carried out in any manner. In some embodiments, the detection of the cleavage of the cleavage structure comprises detecting the non-target cleavage product. In yet other embodiments, the detection of the cleavage of the cleavage structure comprises detection of fluorescence, mass, or fluorescence energy transfer. Other detection methods include, but are not limited to detection of radioactivity, luminescence, phosphorescence, fluorescence polarization, and charge. In some embodiments, detection is carried out by a method comprising providing the non-target cleavage product; a composition comprising two single-stranded nucleic acids annealed so as to define a single-stranded portion of a protein binding region; and a protein; and exposing the non-target cleavage product to the single-stranded portion of the protein binding region under conditions such that the protein binds to the protein binding region. In some embodiments, the protein comprises a nucleic acid producing protein, wherein the nucleic acid producing protein binds to the protein-binding region and produces nucleic acid. In some embodiments, the protein-binding region is a template-dependent RNA polymerase binding region (e.g., a T7 RNA polymerase binding region). In other embodiments, the detection is carried out by a method comprising providing the non-target cleavage product; a single continuous strand of nucleic acid comprising a sequence defining a single strand of an RNA polymerase binding region; a template-dependent DNA polymerase; and a template-dependent RNA polymerase; exposing the non-target cleavage product to the RNA polymerase binding region under conditions such that the non-target cleavage product binds to a portion of the single strand of the RNA polymerase binding region to produce a bound non-target cleavage product; exposing the bound non-target cleavage product to the template-dependent DNA polymerase under conditions such that a double-stranded RNA polymerase binding region is produced; and exposing the double-stranded RNA polymerase binding region to the template-dependent RNA polymerase under conditions such that RNA transcripts are produced. In some embodiments, the method further comprises the step of detecting the RNA transcripts. In some embodiments, the template-dependent RNA polymerase is T7 RNA polymerase.

The present invention is not limited by the nature of the 3' portion of the second oligonucleotide. In some preferred embodiments, the 3' portion of the second oligonucleotide comprises a 3' terminal nucleotide not complementary to the target nucleic acid. In some embodiments, the 3' portion of the second oligonucleotide consists of a single nucleotide not complementary to the target nucleic acid.

Any of the components of the method may be attached to a solid support. For example, in some embodiments, the first oligonucleotide is attached to a solid support. In other embodiments, the second oligonucleotide is attached to a solid support.

The cleavage agent can be any agent that is capable of cleaving invasive cleavage structures. In some preferred embodiments, the cleavage agent comprises a structure-specific nuclease. In particularly preferred embodiments, the structure-specific nuclease comprises a thermostable structure-specific nuclease (e.g., a thermostable 5' nuclease). Thermostable structure-specific nucleases include, but are not limited to, those having an amino acid sequence homologous to a portion of the amino acid sequence of a thermostable DNA polymerase derived from a thermophilic organism (e.g., *Thermus aquaticus, Thermus flavus*, and *Thermus thermophilus*). In other embodiments, the thermostable structure-specific nuclease comprises a nuclease from the FEN-1, RAD2 or XPG classes of nucleases, or chimerical structures containing one or more portions of any of the above cleavage agents.

The method is not limited by the nature of the target nucleic acid. In some embodiments, the target nucleic acid is single stranded or double stranded DNA or RNA. In some embodiments, double stranded nucleic acid is rendered single stranded (e.g., by heat) prior to formation of the cleavage structure. In some embodiment, the source of target nucleic acid comprises a sample containing genomic DNA. Sample include, but are not limited to, blood, saliva, cerebral spinal fluid, pleural fluid, milk, lymph, sputum and semen.

In some embodiments, the reaction conditions for the method comprise providing a source of divalent cations. In some preferred embodiments, the divalent cation is selected from the group comprising $Mn^{2+}$ and $Mg^{2+}$ ions. In some embodiments, the reaction conditions for the method comprise providing the first and the second oligonucleotides in concentration excess compared to the target nucleic acid.

In some embodiments, the method further comprises providing a third oligonucleotide complementary to a third portion of said target nucleic acid upstream of the first portion of the target nucleic acid, wherein the third oligonucleotide is mixed with the reaction mixture.

The present invention also provides a method for detecting the presence of a target nucleic acid molecule by detecting non-target cleavage products comprising providing: a cleavage agent; a source of target nucleic acid, the target nucleic acid comprising a first region and a second region, the second region downstream of and contiguous to the first region; a plurality of first oligonucleotides, wherein at least a portion of the first oligonucleotides is completely complementary to the first portion of the target nucleic acid; a second oligonucleotide comprising a 3' portion and a 5' portion, wherein said 5' portion is completely complementary to the second portion of the target nucleic acid; mixing the cleavage agent, the target nucleic acid, the plurality of first oligonucleotides and second oligonucleotide to create a reaction mixture under reaction conditions such that at least the portion of a first oligonucleotide is annealed to the first region of the target nucleic acid and wherein at least the 5' portion of the second oligonucleotide is annealed to the second region of the target nucleic acid so as to create a cleavage structure, and wherein cleavage of the cleavage structure occurs to generate non-target cleavage product, wherein the conditions permit multiple cleavage structures to form and be cleaved from the target nucleic acid; and detecting the cleavage of said cleavage structures. In some embodiments, the conditions comprise isothermal conditions that permit the plurality of first oligonucleotides to dissociate from the target nucleic acid. While the present invention is limited by the number of cleavage structure formed on a particular target nucleic acid, in some preferred embodiments, two or more (3, 4, 5, . . . , 10, . . . , 10000, . . . ) of the plurality of first oligonucleotides form cleavage structures with a particular target nucleic acid, wherein the cleavage structures are cleaved to produce the non-target cleavage products.

The present invention also provides methods wherein a cleavage product from the above methods is used in a further invasive cleavage reaction. For example, the present invention provides a method comprising providing a cleavage agent; a first target nucleic acid, the first target nucleic acid comprising a first region and a second region, the second region downstream of and contiguous to the first region; a first oligonucleotide, wherein at least a portion of the first oligonucleotide is completely complementary to the first portion of the first target nucleic acid; a second oligonucleotide comprising a 3' portion and a 5' portion, wherein the 5' portion is completely complementary to the second portion of the first target nucleic acid; a second target nucleic acid, said second target nucleic acid comprising a first region and a second region, the second region downstream of and contiguous to the first region; and a third oligonucleotide, wherein at least a portion of the third oligonucleotide is completely complementary to the first portion of the second target nucleic acid; generating a first cleavage structure wherein at least said portion of the first oligonucleotide is annealed to the first region of the first target nucleic acid and wherein at least the 5' portion of the second oligonucleotide is annealed to the second region of the first target nucleic acid and wherein cleavage of the first cleavage structure occurs via the cleavage agent thereby cleaving the first oligonucleotide to generate a fourth oligonucleotide, said fourth oligonucleotide comprising a 3' portion and a 5' portion, wherein the 5' portion is completely complementary to the second portion of the second target nucleic acid; generating a second cleavage structure under conditions wherein at least said portion of the third oligonucleotide is annealed to the first region of the second target nucleic acid and wherein at least the 5' portion of the fourth oligonucleotide is annealed to the second region of the second target nucleic acid and wherein cleavage of the second cleavage structure occurs to generate a cleavage fragment; and detecting the cleavage of the second cleavage structure. In some preferred embodiments, the 3' portion of the fourth oligonucleotide comprises a 3' terminal nucleotide not complementary to the second target nucleic acid. In some embodiments, the 3' portion of the third oligonucleotide is covalently linked to the second target nucleic acid. In some embodiments, the second target nucleic acid further comprises a 5' region, wherein the 5' region of the second target nucleic acid is the third oligonucleotide. The present invention further provides kits comprising: a cleavage agent; a first oligonucleotide comprising a 5' portion complementary to a first region of a target nucleic acid; and a second oligonucleotide comprising a 3' portion and a 5' portion, said 5' portion complementary to a second region of the target nucleic acid downstream of and contiguous to the first portion. In some embodiments, the 3' portion of the second oligonucleotide comprises a 3' terminal nucleotide not complementary to the target nucleic acid. In preferred embodiments, the 3' portion of the second oligonucleotide consists of a single nucleotide not complementary to the target nucleic acid. In some embodiments, the kit further comprises a solid support. For example, in some embodiments, the first and/or second oligonucleotide is attached to said solid support. In some embodiments, the kit further comprises a buffer solution. In some preferred embodiments, the buffer solution comprises a source of divalent cations (e.g., $Mn^{2+}$ and/or $Mg^{2+}$ ions). In some specific embodiments, the kit further comprises a third oligonucleotide complementary to a third portion of the target nucleic acid upstream of the first portion of the first target nucleic acid. In yet other embodiments, the kit further comprises a target nucleic acid. In some embodiments, the kit further comprises a second target nucleic acid. In yet other embodiments, the kit further comprises a third oligonucleotide comprising a 5' portion complementary to a first region of the second target nucleic acid. In some specific embodiments, the 3' portion of the third oligonucleotide is covalently linked to the second target nucleic acid. In other specific embodiments, the second target nucleic acid further comprises a 5' portion, wherein the 5' portion of the second target nucleic acid is the third oligonucleotide. In still other embodiments, the kit further comprises an ARRESTOR molecule (e.g., ARRESTOR oligonucleotide).

The present invention further provides a composition comprising a cleavage structure, the cleavage structure comprising: a) a target nucleic acid, the target nucleic acid having a first region, a second region, a third region and a fourth region, wherein the first region is located adjacent to and downstream from the second region, the second region is located adjacent to and downstream from the third region and the third region is located adjacent to and downstream from the fourth region; b) a first oligonucleotide complementary to the fourth region of the target nucleic acid; c) a second oligonucleotide having a 5' portion and a 3' portion wherein the 5' portion of the second oligonucleotide contains a sequence complementary to the second region of the target nucleic acid and wherein the 3' portion of the second oligonucleotide contains a sequence complementary to the third region of the target nucleic acid; and d) a third oligonucleotide having a 5' portion and a 3' portion wherein the 5' portion of the third oligonucleotide contains a sequence complementary to the first region of the target nucleic acid and wherein the 3' portion of the third oligonucleotide contains a sequence complementary to the second region of the target nucleic acid.

The present invention is not limited by the length of the four regions of the target nucleic acid. In one embodiment, the first region of the target nucleic acid has a length of 11 to 50 nucleotides. In another embodiment, the second region of the target nucleic acid has a length of one to three nucleotides. In another embodiment, the third region of the target nucleic acid has a length of six to nine nucleotides. In yet another embodiment, the fourth region of the target nucleic acid has a length of 6 to 50 nucleotides.

The invention is not limited by the nature or composition of the of the first, second, third and fourth oligonucleotides; these oligonucleotides may comprise DNA, RNA, PNA and combinations thereof as well as comprise modified nucleotides, universal bases, adducts, etc. Further, one or more of the first, second, third and the fourth oligonucleotides may contain a dideoxynucleotide at the 3' terminus.

In one preferred embodiment, the target nucleic acid is not completely complementary to at least one of the first, the second, the third and the fourth oligonucleotides. In a particularly preferred embodiment, the target nucleic acid is not completely complementary to the second oligonucleotide.

As noted above, the present invention contemplates the use of structure-specific nucleases in detection methods. In one embodiment, the present invention provides a method of detecting the presence of a target nucleic acid molecule by detecting non-target cleavage products comprising: a) providing: i) a cleavage means, ii) a source of target nucleic acid, the target nucleic acid having a first region, a second region, a third region and a fourth region, wherein the first region is located adjacent to and downstream from the second region, the second region is located adjacent to and downstream from the third region and the third region is located adjacent to and downstream from the fourth region; iii) a first oligonucleotide complementary to the fourth region of the target nucleic acid; iv) a second oligonucleotide having a 5' portion and a 3' portion wherein the 5' portion of the second oligonucleotide contains a sequence complementary to the second region of the target nucleic acid and wherein the 3' portion of the second oligonucleotide contains a sequence complementary to the third region of the target nucleic acid; iv) a third oligonucleotide having a 5' and a 3' portion wherein the 5' portion of the third oligonucleotide contains a sequence complementary to the first region of the target nucleic acid and wherein the 3' portion of the third oligonucleotide contains a sequence complementary to the second region of the target nucleic acid; b) mixing the cleavage means, the target nucleic acid, the first oligonucleotide, the second oligonucleotide and the third oligonucleotide to create a reaction mixture under reaction conditions such that the first oligonucleotide is annealed to the fourth region of the target nucleic acid and wherein at least the 3' portion of the second oligonucleotide is annealed to the target nucleic acid and wherein at least the 5' portion of the third oligonucleotide is annealed to the target nucleic acid so as to create a cleavage structure and wherein cleavage of the cleavage structure occurs to generate non-target cleavage products, each non-target cleavage product having a 3'-hydroxyl group; and c) detecting the non-target cleavage products.

The invention is not limited by the nature of the target nucleic acid. In one embodiment, the target nucleic acid comprises single-stranded DNA. In another embodiment, the target nucleic acid comprises double-stranded DNA and prior to step c), the reaction mixture is treated such that the double-stranded DNA is rendered substantially single-stranded. In another embodiment, the target nucleic acid comprises RNA and the first and second oligonucleotides comprise DNA.

The invention is not limited by the nature of the cleavage means. In one embodiment, the cleavage means is a structure-specific nuclease; particularly preferred structure-specific nucleases are thermostable structure-specific nucleases.

In another preferred embodiment the thermostable structure specific nuclease is a chimerical nuclease.

In an alternative preferred embodiment, the detection of the non-target cleavage products comprises electrophoretic separation of the products of the reaction followed by visualization of the separated non-target cleavage products.

In another preferred embodiment, one or more of the first, second, and third oligonucleotides contain a dideoxynucleotide at the 3' terminus. When dideoxynucleotide-containing oligonucleotides are employed, the detection of the non-target cleavage products preferably comprises: a) incubating the non-target cleavage products with a template-independent polymerase and at least one labeled nucleoside triphosphate under conditions such that at least one labeled nucleotide is added to the 3'-hydroxyl group of the non-target cleavage products to generate labeled non-target cleavage products; and b) detecting the presence of the labeled non-target cleavage products. The invention is not limited by the nature of the template-independent polymerase employed; in one embodiment, the template-independent polymerase is selected from the group consisting of terminal deoxynucleotidyl transferase (TdT) and poly A polymerase. When TdT or polyA polymerase are employed in the detection step, the second oligonucleotide may contain a 5' end label, the 5' end label being a different label than the label present upon the labeled nucleoside triphosphate. The invention is not limited by the nature of the 5' end label; a wide variety of suitable 5' end labels are known to the art and include biotin, fluorescein, tetrachlorofluorescein, hexachlorofluorescein, Cy3 amidite, Cy5 amidite and digoxigenin.

In another embodiment, detecting the non-target cleavage products comprises: a) incubating the non-target cleavage products with a template-independent polymerase and at least one nucleoside triphosphate under conditions such that at least one nucleotide is added to the 3'-hydroxyl group of the non-target cleavage products to generate tailed non-target cleavage products; and b) detecting the presence of the tailed non-target cleavage products. The invention is not limited by the nature of the template-independent polymerase employed; in one embodiment, the template-independent polymerase is selected from the group consisting of terminal deoxynucleotidyl transferase (TdT) and poly A polymerase. When TdT or polyA polymerases are employed in the detection step, the second oligonucleotide may contain a 5' end label. The invention is not limited by the nature of the 5' end label; a wide variety of suitable 5' end labels are known to the art and include biotin, fluorescein, tetrachlorofluorescein, hexachlorofluorescein, REDMOND RED dye, Cy3 amidite, Cy5 amidite and digoxigenin.

In a preferred embodiment, the reaction conditions comprise providing a source of divalent cations; particularly preferred divalent cations are $Mn^{2+}$ and $Mg^{2+}$ ions.

The present invention further provides a method of detecting the presence of a target nucleic acid molecule by detecting non-target cleavage products comprising: a) providing: i) a cleavage means, ii) a source of target nucleic acid, the target nucleic acid having a first region, a second region and a third region, wherein the first region is located adjacent to and downstream from the second region and wherein the second region is located adjacent to and downstream from the third region; iii) a first oligonucleotide having a 5' and a 3' portion wherein the 5' portion of the first oligonucleotide contains a sequence complementary to the second region of the target nucleic acid and wherein the 3' portion of the first oligonucleotide contains a sequence complementary to the third region of the target nucleic acid; iv) a second oligonucleotide having a length between eleven to fifteen nucleotides and further having a 5' and a 3' portion wherein the 5' portion of the second oligonucleotide contains a sequence complementary to the first region of the target nucleic acid and wherein the 3' portion of the second oligonucleotide contains a sequence complementary to the second region of the target nucleic acid; b) mixing the cleavage means, the target nucleic acid, the first oligonucleotide and the second oligonucleotide to create a reaction mixture under reaction conditions such that at least the 3' portion of the first oligonucleotide is annealed to the target nucleic acid and wherein at least the 5' portion of the second oligonucleotide is annealed to the target nucleic acid so as to create a cleavage structure and wherein cleavage of the cleavage structure occurs to generate non-target cleavage products, each non-target cleavage product having a 3'-hydroxyl group; and c) detecting the non-target cleavage products. In a preferred embodiment the cleavage means is a structure-specific nuclease, preferably a thermostable structure-specific nuclease.

The invention is not limited by the length of the various regions of the target nucleic acid. In a preferred embodiment, the second region of the target nucleic acid has a length between one to five nucleotides. In another preferred embodiment, one or more of the first and the second oligonucleotides contain a dideoxynucleotide at the 3' terminus. When dideoxynucleotide-containing oligonucleotides are employed, the detection of the non-target cleavage products preferably comprises: a) incubating the non-target cleavage products with a template-independent polymerase and at least one labeled nucleoside triphosphate under conditions such that at least one labeled nucleotide is added to the 3'-hydroxyl group of the non-target cleavage products to generate labeled non-target cleavage products; and b) detecting the presence of the labeled non-target cleavage products. The invention is not limited by the nature of the template-independent polymerase employed; in one embodiment, the template-independent polymerase is selected from the group consisting of terminal deoxynucleotidyl transferase (TdT) and poly A polymerase. When TdT or polyA polymerase is employed in the detection step, the second oligonucleotide may contain a 5' end label, the 5' end label being a different label than the label present upon the labeled nucleoside triphosphate. The invention is not limited by the nature of the 5' end label; a wide variety of suitable 5' end labels are known to the art and include biotin, fluorescein, tetrachlorofluorescein, hexachlorofluorescein, REDMOND RED dye, Cy3 amidite, Cy5 amidite and digoxigenin.

In another embodiment, detecting the non-target cleavage products comprises: a) incubating the non-target cleavage products with a template-independent polymerase and at least one nucleoside triphosphate under conditions such that at least one nucleotide is added to the 3'-hydroxyl group of the non-target cleavage products to generate tailed non-target cleavage products; and b) detecting the presence of the tailed non-target cleavage products. The invention is not limited by the nature of the template-independent polymerase employed; in one embodiment, the template-independent polymerase is selected from the group consisting of terminal deoxynucleotidyl transferase (TdT) and poly A polymerase. When TdT or polyA polymerases are employed in the detection step, the second oligonucleotide may contain a 5' end label. The invention is not limited by the nature of the 5' end label; a wide variety of suitable 5' end labels are known to the art and include biotin, fluorescein, tetrachlorofluorescein, hexachlorofluorescein, REDMOND RED dye, Cy3 amidite, Cy5 amidite and digoxigenin.

The novel detection methods of the invention may be employed for the detection of target DNAs and RNAs including, but not limited to, target DNAs and RNAs comprising wild type and mutant alleles of genes, including genes from humans or other animals that are or may be associated with disease or cancer. In addition, the methods of the invention may be used for the detection of and/or identification of strains of microorganisms, including bacteria, fungi, protozoa, ciliates and viruses (and in particular for the detection and identification of RNA viruses, such as HCV).

The present invention further provides novel enzymes designed for direct detection, characterization and quantitation of nucleic acids, particularly RNA. The present invention provides enzymes that recognize specific nucleic acid cleavage structures formed on a target RNA sequence and that cleave the nucleic acid cleavage structure in a site-specific manner to produce non-target cleavage products. The present invention provides enzymes having an improved ability to specifically cleave a DNA member of a complex comprising DNA and RNA nucleic acid strands.

For example, the present invention provides DNA polymerases that are altered in structure relative to the native DNA polymerases, such that they exhibit altered (e.g., improved) performance in detection assays based on the cleavage of a structure comprising nucleic acid (e.g., RNA). In particular, the altered polymerases of the present invention exhibit improved performance in detection assays based on the cleavage of a DNA member of a cleavage structure (e.g., an invasive cleavage structure) that comprises an RNA target strand.

The improved performance in a detection assay may arise from any one of, or a combination of several improved features. For example, in one embodiment, the enzyme of the present invention may have an improved rate of cleavage ($k_{cat}$) on a specific targeted structure, such that a larger amount of a cleavage product may be produced in a given time span. In another embodiment, the enzyme of the present invention may have a reduced activity or rate in the cleavage of inappropriate or non-specific structures. For example, in certain embodiments of the present invention, one aspect of improvement is that the differential between the detectable amount of cleavage of a specific structure and the detectable amount of cleavage of any alternative structures is increased. As such, it is within the scope of the present invention to provide an enzyme having a reduced rate of cleavage of a specific target structure compared to the rate of the native enzyme, and having a further reduced rate of cleavage of any alternative structures, such that the differential between the detectable amount of cleavage of the specific structure and the detectable amount of cleavage of any alternative structures is increased. However, the present invention is not limited to enzymes that have an improved differential.

In a preferred embodiment, the enzyme of the present invention is a DNA polymerase having an altered nuclease activity as described above, and also having altered synthetic activity, compared to that of any native DNA polymerase from which the enzyme has been derived. It is especially preferred that the DNA polymerase is altered such that it exhibits reduced synthetic activity as well as improved nuclease activity on RNA targets, compared to that of the native DNA polymerase. Enzymes and genes encoding enzymes having reduced synthetic activity have been described (See e.g., Kaiser et al., J. Biol. Chem., 274:21387 [1999], Lyamichev et al., Prot. Natl. Acad. Sci., 96:6143 [1999], U.S. Pat. Nos. 5,541,311, 5,614,402, 5,795, 763 and 6,090,606, incorporated herein by reference in their entireties). The present invention contemplates combined modifications, such that the resulting 5' nucleases are without interfering synthetic activity, and have improved performance in RNA detection assays.

The present invention contemplates a DNA sequence encoding a DNA polymerase altered in sequence relative to the native sequence, such that it exhibits altered nuclease activity from that of the native DNA polymerase. For example, in one embodiment, the DNA sequence encodes an enzyme having an improved rate of cleavage ($k_{cat}$) on a specific targeted structure, such that a larger amount of a cleavage product may be produced in a given time span. In another embodiment, the DNA encodes an enzyme having a reduced activity or rate in the cleavage of inappropriate or non-specific structures. In certain embodiments, one aspect of improvement is that the differential between the detectable amount of cleavage of a specific structure and the detectable amount of cleavage of any alternative structures is increased. It is within the scope of the present invention to provide a DNA encoding an enzyme having a reduced rate of cleavage of a specific target structure compared to the rate of the native enzyme, and having a further reduced rate of cleavage of any alternative structures, such that the differential between the detectable amount of cleavage of the specific structure and the detectable amount of cleavage of any alternative structures is increased. However, the present invention is not limited to polymerases that have an improved differential.

In a preferred embodiment, the DNA sequence encodes a DNA polymerase having the altered nuclease activity described above, and also having altered synthetic activity, compared to that of any native DNA polymerase from which the improved enzyme is derived. It is especially preferred that the encoded DNA polymerase is altered such that it exhibits reduced synthetic activity as well as improved nuclease activity oil RNA targets, compared to that of the native DNA polymerase.

It is not intended that the invention be limited by the nature of the alteration required to introduce altered nuclease activity. Nor is it intended that the invention be limited by the extent of either the alteration, or in the improvement observed. If the polymerase is also altered so as to be synthesis modified, it is not intended that the invention be limited by the polymerase activity of the modified or unmodified protein, or by the nature of the alteration to render the polymerase synthesis modified.

The present invention contemplates structure-specific nucleases from a variety of sources, including, but not limited to, mesophilic, psychrophilic, thermophilic, and hyperthermophilic organisms. The preferred structure-specific nucleases are thermostable. Thermostable structure-specific nucleases are contemplated as particularly useful in that they allow the INVADER assay (See e.g., U.S. Pat. Nos. 5,846,717, 5,985,557, 5,994,069, 6,001,567, and 6,090,543 and PCT Publications WO 97/27214 and WO 98/42873, incorporated herein by reference in their entireties) to be operated near the melting temperature ($T_m$) of the downstream probe oligonucleotide, so that cleaved and uncleaved probes may cycle on and off the target during the course of the reaction. In one embodiment, the thermostable structure-specific enzymes are thermostable 5' nucleases that are selected from the group comprising altered polymerases derived from the native polymerases of *Thermus* species, including, but not limited to, *Thermus aquaticus, Thermus flavus, Thermus thermophilus, Thermus filiformus*, and *Thermus scotoductus*. However, the invention is not limited to the use of thermostable 5' nucleases. For example, certain embodiments of the present invention utilize short oligonucleotide probes that may cycle on and off of the target at low temperatures, allowing the use of non-thermostable enzymes.

In some preferred embodiments, the present invention provides a composition comprising an enzyme, wherein the enzyme comprises a heterologous functional domain, wherein the heterologous functional domain provides altered (e.g., improved) functionality in a nucleic acid cleavage assay. The present invention is not limited by the nature of the nucleic acid cleavage assay. For example, nucleic acid cleavage assays include any assay in which a nucleic acid is cleaved, directly or indirectly, in the presence of the enzyme. In certain preferred embodiments, the nucleic acid cleavage assay is an invasive cleavage assay. In particularly preferred embodiments, the cleavage assay utilizes a cleavage structure having at least one RNA component. In another particularly preferred embodiment, the cleavage assay utilizes a cleavage structure having at least one RNA component, wherein a DNA member of the cleavage structure is cleaved.

In some preferred embodiments, the enzyme comprises a 5' nuclease or a polymerase. In certain preferred embodiments, the 5' nuclease comprises a thermostable 5' nuclease. In other preferred embodiments, the polymerase is altered in sequence relative to a naturally occurring sequence of a polymerase such that it exhibits reduced DNA synthetic activity from that of the naturally occurring poly erase. In certain preferred embodiments, the polymerase comprises a thermostable polymerase (e.g., a polymerase from a *Thermus* species including, but not limited to, *Thermus aquaticus, Thermus flavus, Thermus thermophilus, Thermus filiformus*, and *Thermus scotoductus*).

The present invention is not limited by the nature of the altered functionality provided by the heterologous functional domain. Illustrative examples of alterations include, but are not limited to, enzymes where the heterologous functional domain comprises an amino acid sequence (e.g., one or more amino acids) that provides an improved nuclease activity, an improved substrate binding activity and/or improved background specificity in a nucleic acid cleavage assay.

The present invention is not limited by the nature of the heterologous functional domain. For example, in some embodiments, the heterologous functional domain comprises two or more amino acids from a polymerase domain of a polymerase (e.g., introduced into the enzyme by insertion of a chimeric functional domain or created by mutation). In certain preferred embodiment, at least one of the two or more amino acids is from a palm or thumb region of the polymerase domain. The present invention is not limited by the identity of the polymerase from which the two or more amino acids are selected. In certain preferred embodiments, the polymerase comprises *Thermus thermophilus* polymerase. In particularly preferred embodiments, the two or more amino acids are from amino acids 300–650 of SEQ ID NO:1.

The novel enzymes of the invention may be employed for the detection of target DNAs and RNAs including, but not limited to, target DNAs and RNAs comprising wild type and mutant alleles of genes, including, but not limited to, genes from humans, other animal, or plants that are or may be associated with disease or other conditions. In addition, the enzymes of the invention may be used for the detection of and/or identification of strains of microorganisms, including bacteria, fungi, protozoa, ciliates and viruses (and in particular for the detection and identification of viruses having RNA genomes, such as the Hepatitis C and Human Immunodeficiency viruses). For example, the present invention provides methods for cleaving a nucleic acid comprising providing: an enzyme of the present invention and a substrate nucleic acid; and exposing the substrate nucleic acid to the enzyme (e.g., to produce a cleavage product that may be detected).

In one embodiment, the present invention provides a thermostable 5' nuclease having an amino acid sequence selected from the group comprising SEQ ID NOS:2, 3, 4, 5, 6, 7, 8, 9, 10, 11 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 341, 346, 348, 351, 353, 359, 365, 367, 369, 374, 376, 380, 384, 388, 392, 396, 400, 402, 406, 408, 410, 412, 416, 418, 420, 424, 427, 429, 432, 436, 440, 444, 446, 448, 450, 456, 460, 464, 468, 472, 476, 482, 485, 488, 491, 494, 496, 498, 500, 502, 506, 510, 514, 518, 522, 526, 530, 534, 538, 542, 544, 550, 553, 560, 564, 566, 568, 572, 574, 576, 578, 580, 582, 584, 586, 588, 590, 2641–2674, 2710, 2712, 2714, 2717, 2719, 2722, 2724, 2726, 2728, 2730, 2732, 2734, 2736, 2738, 2740, 2742, 2744, 2746, 2748, 2750, 2752, 2754, 2756, 2758, 2760, 2762, 2766, 2768, 2770, 2772, 2774, 2776, 2778, 2780, 2781, 2782, 2783, 2785, 2787, 2789, 2791, 2793, 2795, 2797, 2799, 2801, 2803, 2805, 2807, 2809, 2811, 2813, 2815, 2817, 2819, 2821, 2823, 2825, 2827, 2829, 2831, 2833, 2835, and 2837. In another embodiment, the 5' nuclease is encoded by a DNA sequence selected from the group comprising of SEQ ID NOS:69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 340, 345, 347, 350, 352, 358, 364, 366, 368, 373, 375, 379, 383, 387, 391, 395, 399, 401, 405, 407, 409, 411, 415, 417, 419, 423, 426, 428, 431, 435, 439, 443, 445, 447, 449, 452, 454, 455, 459, 463, 467, 471, 475, 481, 484, 495, 497, 499, 501, 505, 509, 513, 517, 521, 525, 529, 533, 537, 541, 543, 549, 552, 559, 563, 565, 567, 571, 573, 575, 577, 579, 581, 583, 585, 587, 589, 2675–2709, 2711, 2713, 2715, 2716, 2718, 2720, 2721, 2723, 2725, 2727, 2729, 2731, 2733, 2735, 2737, 2739, 2741, 2743 2745, 2747, 2749, 2751, 2753, 2755, 2757, 2759, 2761, 2763, 2764, 2765, 2767, 2769, 2771, 2773, 2775, 2777, 2779, 2784, 2786, 2788, 2790, 2792, 2794, 2796, 2798, 2800, 2802, 2804, 2806, 2808, 2810, 2812, 2814, 2816, 2818, 2820, 2822, 2824, 2826, 2828, 2830, 2832, 2834, and 2836.

The present invention also provides a recombinant DNA vector comprising DNA having a nucleotide sequence encoding a 5' nuclease, the nucleotide sequence selected from the group comprising SEQ ID NOS: 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 340, 345, 347, 350, 352, 358, 364, 366, 368, 373, 375, 379, 383, 387, 391, 395, 399, 401, 405, 407, 409, 411, 415, 417, 419, 423, 426, 428, 431, 435, 439, 443, 445, 447, 449, 452, 454, 455, 459, 463, 467, 471, 475, 481, 484, 495, 497, 499, 501, 505, 509, 513, 517, 521, 525, 529, 533, 537, 541, 543, 549, 552, 559, 563, 565, 567, 571, 573, 575, 577, 579, 581, 583, 585, 587, 589, 2675–2709, 2711, 2713, 2715, 2716, 2718, 2720, 2721, 2723, 2725, 2727, 2729, 2731, 2733, 2735, 2737, 2739, 2741, 2743 2745, 2747, 2749, 2751, 2753, 2755, 2757, 2759, 2761, 2763, 2764, 2765, 2767, 2769, 2771, 2773, 2775, 2777, 2779, 2784, 2786, 2788, 2790, 2792, 2794, 2796, 2798, 2800, 2802, 2804, 2806, 2808, 2810, 2812, 2814, 2816, 2818, 2820, 2822, 2824, 2826, 2828, 2830, 2832, 2834, and 2836. In a preferred embodiment, the invention provides a host cell transformed with a recombinant DNA vector comprising DNA having a nucleotide sequence encoding a structure-specific nuclease, the nucleotide selected from the group comprising sequence SEQ ID NOS: 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 340, 345, 347, 350, 352, 358, 364, 366, 368, 373, 375, 379, 383, 387, 391, 395, 399, 401, 405, 407, 409, 411, 415, 417, 419, 423, 426, 428, 431, 435, 439, 443, 445, 447, 449, 452, 454, 455, 459, 463, 467, 471, 475, 481, 484, 495, 497, 499, 501, 505, 509, 513, 517, 521, 525, 529, 533, 537, 541, 543, 549, 552, 559, 563, 565, 567, 571, 573, 575, 577, 579, 581, 583, 585, 587, 589, 2675–2709, 2711, 2713, 2715, 2716, 2718, 2720, 2721, 2723, 2725, 2727, 2729, 2731, 2733, 2735, 2737, 2739, 2741, 2743 2745, 2747, 2749, 2751, 2753, 2755, 2757, 2759, 2761, 2763, 2764, 2765, 2767, 2769, 2771, 2773, 2775, 2777, 2779, 2784, 2786, 2788, 2790, 2792, 2794, 2796, 2798, 2800, 2802, 2804, 2806, 2808, 2810, 2812, 2814, 2816, 2818, 2820, 2822, 2824, 2826, 2828, 2830, 2832, 2834, and 2836. The invention is not limited by the nature of the host cell employed. The art is well aware of expression vectors suitable for the expression of nucleotide sequences encoding structure-specific nucleases that can be expressed in a variety of prokaryotic and eukaryotic host cells. In a preferred embodiment, the host cell is an *Escherichia coli* cell.

The present invention provides a method of altering 5 nuclease enzymes relative to native 5' nuclease enzymes, such that they exhibit improved performance in detection assays based on the cleavage of a structure comprising RNA. In particular, the altered 5' nucleases produced by the method of the present invention exhibit improved performance in detection assays based on the cleavage of a DNA member of a cleavage structure (e.g., an invasive cleavage structure) that comprises an RNA target strand. The improved 5' nucleases resulting from the methods of the present invention may be improved in any of the ways discussed herein. Examples of processes for assessing improvement in any candidate enzyme are provided.

For example, the present invention provides methods for producing an altered enzyme with improved functionality in a nucleic acid cleavage assay comprising: providing an enzyme and a nucleic acid test substrate; introducing a heterologous functional domain into the enzyme to produce an altered enzyme; contacting the altered enzyme with the nucleic acid test substrate to produce cleavage products; and detecting the cleavage products. In some embodiments, the introduction of the heterologous functional domain comprises mutating one or more amino acids of the enzyme. In other embodiments, the introduction of the heterologous functional domain into the enzyme comprises adding a functional domain from a protein (e.g., another enzyme) into the enzyme (e.g. substituting functional domains by removing a portion of the enzyme sequence prior to adding the functional domain of the protein). In preferred embodiments, the nucleic acid test substrate comprises a cleavage structure. In particularly preferred embodiment, the cleavage structure comprises an RNA target nucleic acid. In yet other preferred embodiments, the cleavage structure comprises an invasive cleavage structure.

The present invention also provides nucleic acid treatment kits. One preferred embodiment is a kit comprising a composition comprising at least one improved 5' nuclease. Another preferred embodiment provides a kit comprising: a) a composition comprising at least one improved 5' nuclease; and b) an INVADER oligonucleotide and a signal probe oligonucleotide. In some embodiments of the kits of the present invention, the improved 5' nuclease is derived from a DNA polymerase from a eubacterial species. In further embodiments, the eubacterial species is a thermophile. In still further embodiments, the thermophile is of the genus *Thermus*. In still further embodiments, the thermophile is selected from the group consisting of *Thermus aquaticus, Thermus flavus, Thermus thermophilus, Thermus filiformus,* and *Thermus scotoductus*. In preferred embodiments, the improved 5' nuclease is encoded by DNA selected from the group comprising SEQ ID NOS: 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 340, 345, 347, 350, 352, 358, 364, 366, 368, 373, 375, 379, 383, 387, 391, 395, 399, 401, 405, 407, 409, 411, 415, 417, 419, 423, 426, 428, 431, 435, 439, 443, 445, 447, 449, 452, 454, 455, 459, 463, 467, 471, 475, 481, 484, 495, 497, 499, 501, 505, 509, 513, 517, 521, 525, 529, 533, 537, 541, 543, 549, 552, 559, 563, 565, 567, 571, 573, 575, 577, 579, 581, 583, 585, 587, 589, 2675–2709, 2711, 2713, 2715, 2716, 2718, 2720, 2721, 2723, 2725, 2727, 2729, 2731, 2733, 2735, 2737, 2739, 2741, 2743 2745, 2747, 2749, 2751, 2753, 2755, 2757, 2759, 2761, 2763, 2764, 2765, 2767, 2769, 2771, 2773, 2775, 2777, 2779, 2784, 2786, 2788, 2790, 2792, 2794, 2796, 2798, 2800, 2802, 2804, 2806, 2808, 2810, 2812, 2814, 2816, 2818, 2820, 2822, 2824, 2826, 2828, 2830, 2832, 2834, and 2836. In yet other preferred embodiments, the kits further comprise reagents for detecting a nucleic acid cleavage product. In further preferred embodiments, the reagents for detecting a cleavage product comprise oligonucleotides for use in a subsequent invasive cleavage reaction (See e.g., U.S. Pat. No. 5,994,069). In particularly preferred embodiments, the reagents for the subsequent invasive cleavage reaction comprise a probe labeled with moieties that produce a fluorescence resonance energy transfer (FRET) effect.

The present invention also provides methods for treating nucleic acid, comprising: a) providing: a first structure-specific nuclease consisting of an endonuclease in a solution containing manganese; and a nucleic acid substrate; b) treating the nucleic acid substrate with increased temperature such that the substrate is substantially single-stranded; c) reducing the temperature under conditions such that the single-stranded substrate forms one or more cleavage structures; d) reacting the cleavage means with the cleavage structures so that one or more cleavage products are produced; and e) detecting the one or more cleavage products. In some embodiments of the methods, the endonuclease includes, but is not limited to, CLEAVASE BN enzyme, *Thermus aquaticus* DNA polymerase, *Thermus thermophilus* DNA polymerase, *Escherichia coli* Exo III, and the *Saccharomyces cerevisiae* Rad1/Rad10 complex. In yet other preferred embodiments, the nuclease is a 5' nuclease derived from a thermostable DNA polymerase altered in amino acid sequence such that it exhibits reduced DNA synthetic activity from that of the wild-type DNA polymerase but retains substantially the same 5' nuclease activity of the wild-type DNA polymerase. In yet other embodiments, the nucleic acid is selected from the group consisting of RNA and DNA. In further embodiments, the nucleic acid of step (a) is double stranded.

The present invention also provides nucleic acid treatment kits, comprising: a) a composition comprising at least one purified FEN-1 endonuclease; and b) a solution containing manganese. In some embodiments of the kits, the purified FEN-1 endonuclease is selected from the group consisting *Pyrococcus woesei* FEN-1 endonuclease, *Pyrococcus furiosus* FEN-1 endonuclease, *Methanococcus jannaschii* FEN-1 endonuclease, *Methanobacterium thermoautotrophicum* FEN-1 endonuclease, *Archaeoglobus fulgidus* FEN-1, *Sulfolobus solfataricus, Pyrobaculum aerophilum, Thermococcus litoralis, Archaeaglobus veneficus, Archaeaglobus profundus, Acidianus brierlyi, Acidianus ambivalens, Desulfurococcus amylolyticus, Desulfurococcus mobilis, Pyrodictium brockii, Thermococcus gorgonarius, Thermococcus zilligii, Methanopyrus kandleri, Methanococcus igneus, Pyrococcus horikoshii, Aeropyrum pernix*, and chimerical FEN-1 endonucleases. In other embodiments, the kits further comprise at least one second structure-specific nuclease. In some preferred embodiments, the second nuclease is a 5' nuclease derived from a thermostable DNA polymerase altered in amino acid sequence such that it exhibits reduced DNA synthetic activity from that of the wild-type DNA polymerase but retains substantially the same 5' nuclease activity of the wild-type DNA polymerase. In yet other embodiments of the kits, the portion of the amino acid sequence of the second nuclease is homologous to a portion of the amino acid sequence of a thermostable DNA polymerase derived from a eubacterial thermophile of the genus *Thermus*. In further embodiments, the thermophile is selected from the group consisting of *Thermus aquaticus, Thermus flavus* and *Thermus thermophilus*. In yet other preferred embodiments, the kits further comprise reagents for detecting the cleavage products.

The present invention further provides any of the compositions, mixtures, methods, and kits described herein, used in conjunction with endonucleases comprising *Sulfolobus solfataricus, Pyrobaculum aerophilum, Thermococcus litoralis, Archaeaglobus veneficus, Archaeaglobus profundus, Acidianus brierlyi, Acidianus ambivalens, Desulfurococcus amylolyticus, Desulfurococcus mobilis, Pyrodictium brockii, Thermococcus gorgonarius, Thermococcus zilligii, Methanopyrus kandleri, Methanococcus igneus, Pyrococcus horikoshii*, and *Aeropyrum pernix* endonucleases. These include compositions comprising purified FEN-1 endonucleases from the organisms (including specific endonucleases described by sequences provided herein, as well as, variants and homologues), kits comprising these compositions, composition comprising chimerical endonucleases comprising at least a portion of the endonucleases from these organisms, kits comprising such compositions, compositions comprising nucleic acids encoding the endonucleases from these organisms (including vectors and host cells), kits comprising such compositions, antibodies generated to the endonucleases, mixtures comprising endonucleases from these organisms, methods of using the endonuclease in cleavage assays (e.g., invasive cleavage assays, CFLP, etc.), and kits containing components useful for such methods. Examples describing the generation, structure, use, and characterization of these endonucleases are provided herein.

The present invention also provides methods for improving the methods and enzymes disclosed herein. For example, the present invention provides methods of improving enzymes for any intended purpose (e.g., use in cleavage reactions, amplification reactions, binding reactions, or any other use) comprising the step of providing an enzyme disclosed herein and modifying the enzyme (e.g., altering the amino acid sequence, adding or subtracting sequence, adding post-translational modifications, adding any other component whether biological or not, or any other modification). Likewise, the present invention provides methods for improving the methods disclosed herein comprising, conducting the method steps with one or more changes (e.g., change in a composition provided in the method, change in the order of the steps, or addition or subtraction of steps).

The improved performance in a detection assay may arise from any one of, or a combination of several improved features. For example, in one embodiment, the enzyme of the present invention may have an improved rate of cleavage ($k_{cat}$) on a specific targeted structure, such that a larger amount of a cleavage product may be produced in a given time span. In another embodiment, the enzyme of the present invention may have a reduced activity or rate in the cleavage of inappropriate or non-specific structures. For example, in certain embodiments of the present invention, one aspect of improvement is that the differential between the detectable amount of cleavage of a specific structure and the detectable amount of cleavage of any alternative structures is increased. As such, it is within the scope of the present invention to provide an enzyme having a reduced rate of cleavage of a specific target structure compared to the rate of the native enzyme, and having a further reduced rate of cleavage of any alternative structures, such that the differential between the detectable amount of cleavage of the specific structure and the detectable amount of cleavage of any alternative structures is increased. However, the present invention is not limited to enzymes that have an improved differential.

In some preferred embodiments, the present invention provides a composition comprising an enzyme, wherein the enzyme comprises a heterologous functional domain, wherein the heterologous functional domain provides altered (e.g., improved) functionality in a nucleic acid cleavage assay. The present invention is not limited by the nature of the nucleic acid cleavage assay. For example, nucleic acid cleavage assays include any assay in which a nucleic acid is cleaved, directly or indirectly, in the presence of the enzyme. In certain preferred embodiments, the nucleic acid cleavage assay is an invasive cleavage assay. In particularly preferred embodiments, the cleavage assay utilizes a cleavage structure having at least one RNA component. In another particularly preferred embodiment, the cleavage assay utilizes a cleavage structure having at least one RNA component, wherein a DNA member of the cleavage structure is cleaved.

The present invention is not limited by the nature of the altered functionality provided by the heterologous functional domain. Illustrative examples of alterations include, but are not limited to, enzymes where the heterologous functional domain comprises an amino acid sequence (e.g., one or more amino acids) that provides an improved nuclease activity, an improved substrate binding activity and/or improved background specificity in a nucleic acid cleavage assay.

The present invention is not limited by the nature of the heterologous functional domain. For example, in some embodiments, the heterologous functional domain comprises two or more amino acids from a polymerase domain of a polymerase (e.g., introduced into the enzyme by insertion of a chimerical functional domain or created by mutation). In certain preferred embodiment, at least one of the two or more amino acids is from a palm or thumb region of the polymerase domain. The present invention is not limited by the identity of the polymerase from which the two or more amino acids are selected. In certain preferred embodiments, the polymerase comprises Thermus thermophilus polymerase. In particularly preferred embodiments, the two or more amino acids are from amino acids 300–650 of SEQ ID NO:1.

The novel enzymes of the invention may be employed for the detection of target DNAs and RNAs including, but not limited to, target DNAs and RNAs comprising wild type and mutant alleles of genes, including, but not limited to, genes from humans, other animal, or plants that are or may be associated with disease or other conditions. In addition, the enzymes of the invention may be used for the detection of and/or identification of strains of microorganisms, including bacteria, fungi, protozoa, ciliates and viruses (and in particular for the detection and identification of viruses having RNA genomes, such as the Hepatitis C and Human Immunodeficiency viruses). For example, the present invention provides methods for cleaving a nucleic acid comprising providing: an enzyme of the present invention and a substrate nucleic acid; and exposing the substrate nucleic acid to the enzyme (e.g., to produce a cleavage product that may be detected). In some embodiments, the substrate nucleic is in a cell lysate sample.

The present invention also provides a method for detecting the presence of a target nucleic acid comprising: cleaving an invasive cleavage structure, said invasive cleavage structure comprising an RNA target nucleic acid; and detecting the cleavage of the invasive cleavage structure. Such an assay may comprise a multiplex assay, wherein multiple invasive cleavage structures are cleaved. Such structures include structures formed on different target nucleic acids, as well as, structures formed on different locations of the sample target nucleic acid. In some embodiments, the target nucleic acid comprises a first region and a second region, said second region downstream of and contiguous to said first region. In some embodiments, the invasive cleavage structure comprises the target nucleic acid, a first oligonucleotide, and a second oligonucleotide, wherein at least a portion of the first oligonucleotide is completely complementary to the first portion of the first target nucleic acid, and wherein the second oligonucleotide comprises a 3' portion and a 5' portion, wherein the 5' portion is completely complementary to said second portion of the target nucleic acid. In some embodiments, the 3' portion of the second oligonucleotide comprises a 3' terminal nucleotide not complementary to said target nucleic acid. In some embodiments, the 3' portion of the second oligonucleotide consists of a single nucleotide not complementary to the target nucleic acid. In some embodiments, the method further comprises the steps of forming a second invasive cleavage structure comprising a non-target cleavage product and cleaving the second invasive cleavage structure. In some embodiments, the invasive cleavage structure or the second invasive cleavage comprises an oligonucleotide comprising a sequence selected from the group consisting of SEQ ID NO:709–2640. In other embodiments, the invasive cleavage structure or the second invasive cleavage comprises an oligonucleotide comprising a sequence selected from the group consisting of SEQ ID NO: 169–211 and 619–706. In still other embodiments, the invasive cleavage structure or the second invasive cleavage comprises an oligonucleotide comprising a sequence selected from the group consisting of SEQ ID NO:2868–4004. In some preferred embodiments, the target nucleic acid comprises a cytochrome P450 RNA or a cytokine RNA. In some embodiments, the first region or the second region of the target nucleic acid encompasses a splice junction, an exon (or a portion thereof), or an intron (or a portion thereof). In some embodiments, the RNA target nucleic acid is provided in a cell lysate. In some embodiments, the first oligonucleotide is covalently attached to the second oligonucleotide. Such oligonucleotides find use, for example, in methods described in U.S. Pat. Nos. 5,714,320 and 5,854,033, herein incorporated by reference in their entireties. The present invention also provides kits containing one or more of the components used in the above methods.

DEFINITIONS

To facilitate an understanding of the present invention, a number of terms and phrases are defined below:

As used herein, the terms "complementary" or "complementarity" are used in reference to polynucleotides (i.e., a sequence of nucleotides such as an oligonucleotide or a target nucleic acid) related by the base-pairing rules. For example, for the sequence "5'-A-G-T-3'," is complementary to the sequence "3'-T-C-A-5'." Complementarity may be "partial," in which only some of the nucleic acids' bases are matched according to the base pairing rules. Or, there may be "complete" or "total" complementarity between the nucleic acids. The degree of complementarity between nucleic acid strands has significant effects on the efficiency and strength of hybridization between nucleic acid strands. This is of particular importance in amplification reactions, as well as detection methods that depend upon binding between nucleic acids. Either term may also be used in reference to individual nucleotides, especially within the context of polynucleotides. For example, a particular nucleotide within an oligonucleotide may be noted for its complementarity, or lack thereof, to a nucleotide within another nucleic acid strand, in contrast or comparison to the complementarity between the rest of the oligonucleotide and the nucleic acid strand. Nucleotide analogs used to form non-standard base pairs, whether with another nucleotide analog (e.g., an IsoC/IsoG base pair), or with a naturally occurring nucleotide (e.g., as described in U.S. Pat. No. 5,912,340, herein incorporated by reference in its entirety) are also considered to be complementary to a base pairing partner within the meaning this definition. Further, when nucleotides are known to form pairs with multiple different bases, e.g., IsoG nucleotide ability to pair with IsoC and with T nucleotides, each of the bases with which it can form a hydrogen-bonded base-pair falls within the meaning of "complementary," as used herein. "Universal" bases, i.e., those that can form base pairs with several other bases, such as the "wobble" base inosine, are considered complementary to those bases with which pairs can be formed.

The term "homology" and "homologous" refers to a degree of identity. There may be partial homology or complete homology. A partially homologous sequence is one that is less than 100% identical to another sequence.

As used herein, the term "hybridization" is used in reference to the pairing of complementary nucleic acids. Hybridization and the strength of hybridization (i.e., the strength of the association between the nucleic acids) is influenced by such factors as the degree of complementary between the nucleic acids, stringency of the conditions involved, and the $T_m$ of the formed hybrid. "Hybridization" methods involve the annealing of one nucleic acid to another, complementary nucleic acid, i.e., a nucleic acid having a complementary nucleotide sequence. The ability of two polymers of nucleic acid containing complementary sequences to find each other and anneal through base pairing interaction is a well-recognized phenomenon. The initial observations of the "hybridization" process by Marmur and Lane, Proc. Natl. Acad. Sci. USA 46:453 (1960) and Doty et al., Proc. Natl. Acad. Sci. USA 46:461 (1960) have been followed by the refinement of this process into an essential tool of modem biology.

With regard to complementarity, it is important for some diagnostic applications to determine whether the hybridization represents complete or partial complementarity. For example, where it is desired to detect simply the presence or absence of pathogen DNA (such as from a virus, bacterium, fungi, mycoplasma, protozoan) it is only important that the hybridization method ensures hybridization when the relevant sequence is present; conditions can be selected where both partially complementary probes and completely complementary probes will hybridize. Other diagnostic applications, however, may require that the hybridization method distinguish between partial and complete complementarity. It may be of interest to detect genetic polymorphisms. For example, human hemoglobin is composed, in part, of four polypeptide chains. Two of these chains are identical chains of 141 amino acids (alpha chains) and two of these chains are identical chains of 146 amino acids (beta chains). The gene encoding the beta chain is known to exhibit polymorphism. The normal allele encodes a beta chain having glutamic acid at the sixth position. The mutant allele encodes a beta chain having valine at the sixth position. This difference in amino acids has a profound (most profound when the individual is homozygous for the mutant allele) physiological impact known clinically as sickle cell anemia. It is well known that the genetic basis of the amino acid change involves a single base difference between the normal allele DNA sequence and the mutant allele DNA sequence.

The complement of a nucleic acid sequence as used herein refers to an oligonucleotide which, when aligned with the nucleic acid sequence such that the 5' end of one sequence is paired with the 3' end of the other, is in "antiparallel association." Certain bases not commonly found in natural nucleic acids may be included in the nucleic acids of the present invention and include, for example, inosine and 7-deazaguanine. Complementarity need not be perfect; stable duplexes may contain mismatched base pairs or unmatched bases. Those skilled in the art of nucleic acid technology can determine duplex stability empirically considering a number of variables including, for example, the length of the oligonucleotide, base composition and sequence of the oligonucleotide, ionic strength and incidence of mismatched base pairs.

As used herein, the term "$T_m$" is used in reference to the "melting temperature." The melting temperature is the temperature at which a population of double-stranded nucleic acid molecules becomes half dissociated into single strands. Several equations for calculating the $T_m$ of nucleic acids are well known in the art. As indicated by standard references, a simple estimate of the $T_m$ value may be calculated by the equation: $T_m=81.5+0.41(\% \text{ G}+\text{C})$, when a nucleic acid is in aqueous solution at 1 M NaCl (see e.g., Anderson and Young, Quantitative Filter Hybridization, in Nucleic Acid Hybridization (1985). Other references (e.g., Allawi, H. T. & SantaLucia, J., Jr. Thermodynamics and NMR of internal G.T mismatches in DNA. Biochemistry 36, 10581–94 (1997) include more sophisticated computations which take structural and environmental, as well as sequence characteristics into account for the calculation of $T_m$.

As used herein the term "stringency" is used in reference to the conditions of temperature, ionic strength, and the presence of other compounds, under which nucleic acid hybridizations are conducted. With "high stringency" conditions, nucleic acid base pairing will occur only between nucleic acid fragments that have a high frequency of complementary base sequences. Thus, conditions of "weak" or "low" stringency are often required when it is desired that nucleic acids that are not completely complementary to one another be hybridized or annealed together.

"High stringency conditions" when used in reference to nucleic acid hybridization comprise conditions equivalent to binding or hybridization at 42 C in a solution consisting of 5×SSPE (43.8 g/l NaCl, 6.9 g/l $NaH_2PO_4H_2O$ and 1.85 g/l EDTA, pH adjusted to 7.4 with NaOH), 0.5% SDS, 5× Denhardt's reagent and 100 μg/ml denatured salmon sperm DNA followed by washing in a solution comprising 0.1× SSPE, 1.0% SDS at 42 C when a probe of about 500 nucleotides in length is employed.

"Medium stringency conditions" when used in reference to nucleic acid hybridization comprise conditions equivalent to binding or hybridization at 42 C in a solution consisting of 5×SSPE (43.8 g/l NaCl, 6.9 g/l $NaH_2PO_4H_2O$ and 1.85 g/l EDTA, pH adjusted to 7.4 with NaOH), 0.5% SDS, 5× Denhardt's reagent and 100 μg/ml denatured salmon sperm DNA followed by washing in a solution comprising 1.0× SSPE, 1.0% SDS at 42 C when a probe of about 500 nucleotides in length is employed.

"Low stringency conditions" comprise conditions equivalent to binding or hybridization at 42 C in a solution consisting of 5×SSPE (43.8 g/l NaCl, 6.9 g/l $NaH_2PO_4H_2O$ and 1.85 g/l EDTA, pH adjusted to 7.4 with NaOH), 0.1% SDS, 5× Denhardt's reagent [50× Denhardt's contains per 500 ml: 5 g Ficoll (Type 400, Pharamcia), 5 g BSA (Fraction V; Sigma)] and 100 g/ml denatured salmon sperm DNA followed by washing in a solution comprising 5×SSPE, 0.1% SDS at 42 C when a probe of about 500 nucleotides in length is employed.

The term "gene" refers to a DNA sequence that comprises control and coding sequences necessary for the production of an RNA having a non-coding function (e.g., a ribosomal or transfer RNA), a polypeptide or a precursor. The RNA or polypeptide can be encoded by a full-length coding sequence or by any portion of the coding sequence so long as the desired activity or function is retained.

The term "wild-type" refers to a gene or a gene product that has the characteristics of that gene or gene product when isolated from a naturally occurring source. A wild-type gene is that which is most frequently observed in a population and is thus arbitrarily designated the "normal" or "wild-type" form of the gene. In contrast, the term "modified," "mutant," or "polymorphic" refers to a gene or gene product that displays modifications in sequence and or functional properties (i.e., altered characteristics) when compared to the wild-type gene or gene product. It is noted that naturally-occurring mutants can be isolated; these are identified by the fact that they have altered characteristics when compared to the wild-type gene or gene product.

The term "recombinant DNA vector" as used herein refers to DNA sequences containing a desired heterologous sequence. For example, although the term is not limited to the use of expressed sequences or sequences that encode an expression product, in some embodiments, the heterologous sequence is a coding sequence and appropriate DNA sequences necessary for either the replication of the coding sequence in a host organism, or the expression of the operably linked coding sequence in a particular host organism. DNA sequences necessary for expression in prokaryotes include a promoter, optionally an operator sequence, a ribosome-binding site and possibly other sequences. Eukaryotic cells are known to utilize promoters, polyadenlyation signals and enhancers.

The term "LTR" as used herein refers to the long terminal repeat found at each end of a provirus (i.e., the integrated form of a retrovirus). The LTR contains numerous regulatory signals including transcriptional control elements, polyadenylation signals and sequences needed for replication and integration of the viral genome. The viral LTR is divided into three regions called U3, R and U5.

The U3 region contains the enhancer and promoter elements. The U5 region contains the polyadenylation signals. The R (repeat) region separates the U3 and U5 regions and transcribed sequences of the R region appear at both the 5' and 3' ends of the viral RNA.

The term "oligonucleotide" as used herein is defined as a molecule comprising two or more deoxyribonucleotides or ribonucleotides, preferably at least 5 nucleotides, more preferably at least about 10–15 nucleotides and more preferably at least about 15 to 30 nucleotides. The exact size will depend on many factors, which in turn depend on the ultimate function or use of the oligonucleotide. The oligonucleotide may be generated in any manner, including chemical synthesis, DNA replication, reverse transcription, PCR, or a combination thereof.

Because mononucleotides are reacted to make oligonucleotides in a manner such that the 5' phosphate of one mononucleotide pentose ring is attached to the 3' oxygen of its neighbor in one direction via a phosphodiester linkage, an end of an oligonucleotide is referred to as the "5' end" if its 5' phosphate is not linked to the 3' oxygen of a mononucleotide pentose ring and as the "3' end" if its 3' oxygen is not linked to a 5' phosphate of a subsequent mononucleotide pentose ring. As used herein, a nucleic acid sequence, even if internal to a larger oligonucleotide, also may be said to have 5' and 3' ends. A first region along a nucleic acid strand is said to be upstream of another region if the 3' end of the first region is before the 5' end of the second region when moving along a strand of nucleic acid in a 5' to 3' direction.

When two different, non-overlapping oligonucleotides anneal to different regions of the same linear complementary nucleic acid sequence, and the 3' end of one oligonucleotide points towards the 5' end of the other, the former may be called the "upstream" oligonucleotide and the latter the "downstream" oligonucleotide. Similarly, when two overlapping oligonucleotides are hybridized to the same linear complementary nucleic acid sequence, with the first oligonucleotide positioned such that its 5' end is upstream of the 5' end of the second oligonucleotide, and the 3' end of the first oligonucleotide is upstream of the 3' end of the second oligonucleotide, the first oligonucleotide may be called the "upstream" oligonucleotide and the second oligonucleotide may be called the "downstream" oligonucleotide.

The term "primer" refers to an oligonucleotide that is capable of acting as a point of initiation of synthesis when placed under conditions in which primer extension is initiated. An oligonucleotide "primer" may occur naturally, as in a purified restriction digest or may be produced synthetically.

A primer is selected to be "substantially" complementary to a strand of specific sequence of the template. A primer must be sufficiently complementary to hybridize with a template strand for primer elongation to occur. A primer sequence need not reflect the exact sequence of the template. For example, a non-complementary nucleotide fragment may be attached to the 5' end of the primer, with the remainder of the primer sequence being substantially complementary to the strand. Non-complementary bases or longer sequences can be interspersed into the primer, provided that the primer sequence has sufficient complementarity with the sequence of the template to hybridize and thereby form a template primer complex for synthesis of the extension product of the primer.

The term "label" as used herein refers to any atom or molecule that can be used to provide a detectable (preferably quantifiable) effect, and that can be attached to a nucleic acid or protein. Labels include but are not limited to dyes; radiolabels such as $^{32}P$; binding moieties such as biotin; haptens such as digoxgenin; luminogenic, phosphorescent or fluorogenic moieties; and fluorescent dyes alone or in combination with moieties that can suppress or shift emission spectra by fluorescence resonance energy transfer (FRET). Labels may provide signals detectable by fluorescence, radioactivity, colorimetry, gravimetry, X-ray diffraction or absorption, magnetism, enzymatic activity, and the like. A label may be a charged moiety (positive or negative charge) or alternatively, may be charge neutral. Labels can include or consist of nucleic acid or protein sequence, so long as the sequence comprising the label is detectable.

The term "signal" as used herein refers to any detectable effect, such as would be caused or provided by a label or an assay reaction.

As used herein, the term "detector" refers to a system or component of a system, e.g., an instrument (e.g. a camera, fluorimeter, charge-coupled device, scintillation counter, etc.) or a reactive medium (X-ray or camera film, pH indicator, etc.), that can convey to a user or to another component of a system (e.g., a computer or controller) the presence of a signal or effect. A detector can be a photometric or spectrophotometric system, which can detect ultraviolet, visible or infrared light, including fluorescence or chemiluminescence; a radiation detection system; a spectroscopic system such as nuclear magnetic resonance spectroscopy, mass spectrometry or surface enhanced Raman spectrometry; a system such as gel or capillary electrophoresis or gel exclusion chromatography; or other detection systems known in the art, or combinations thereof.

The term "cleavage structure" as used herein, refers to a structure that is formed by the interaction of at least one probe oligonucleotide and a target nucleic acid, forming a structure comprising a duplex, the resulting structure being cleavable by a cleavage agent, including but not limited to an enzyme. The cleavage structure is a substrate for specific cleavage by the cleavage means in contrast to a nucleic acid molecule that is a substrate for non-specific cleavage by agents such as phosphodiesterases that cleave nucleic acid molecules without regard to secondary structure (i.e., no formation of a duplexed structure is required).

The term "folded cleavage structure" as used herein, refers to a region of a single-stranded nucleic acid substrate containing secondary structure, the region being cleavable by an enzymatic cleavage means. The cleavage structure is a substrate for specific cleavage by the cleavage means in contrast to a nucleic acid molecule that is a substrate for non-specific cleavage by agents such as phosphodiesterases that cleave nucleic acid molecules without regard to secondary structure (i.e., no folding of the substrate is required).

As used herein, the term "folded target" refers to a nucleic acid strand that contains at least one region of secondary structure (i.e., at least one double stranded region and at least one single-stranded region within a single strand of the nucleic acid). A folded target may comprise regions of tertiary structure in addition to regions of secondary structure.

The term "cleavage means" or "cleavage agent" as used herein refers to any means that is capable of cleaving a cleavage structure, including but not limited to enzymes. The cleavage means may include native DNAPs having 5' nuclease activity (e.g., Taq DNA polymerase, E. coli DNA polymerase I) and, more specifically, modified DNAPs having 5' nuclease but lacking synthetic activity. "Structure-specific nucleases" or "structure-specific enzymes" are enzymes that recognize specific secondary structures in a nucleic acid molecule and cleave these structures. The cleavage means of the invention cleave a nucleic acid molecule in response to the formation of cleavage structures; it is not necessary that the cleavage means cleave the cleavage structure at any particular location within the cleavage structure.

The cleavage means is not restricted to enzymes having solely 5' nuclease activity. The cleavage means may include nuclease activity provided from a variety of sources including the CLEAVASE enzymes, the FEN-1 endonucleases (including RAD2 and XPG proteins), Taq DNA polymerase and E. coli DNA polymerase I.

The term "thermostable" when used in reference to an enzyme, such as a 5' nuclease, indicates that the enzyme is functional or active (i.e., can perform catalysis) at an elevated temperature, i.e., at about 55° C. or higher.

The term "cleavage products" as used herein, refers to products generated by the reaction of a cleavage means with a cleavage structure (i.e., the treatment of a cleavage structure with a cleavage means).

The term "target nucleic acid" refers to a nucleic acid molecule containing a sequence that has at least partial complementarity with at least a probe oligonucleotide and may also have at least partial complementarity with an INVADER oligonucleotide. The target nucleic acid may comprise single- or double-stranded DNA or RNA, and may comprise nucleotide analogs, labels, and other modifications.

The term "probe oligonucleotide" refers to an oligonucleotide that interacts with a target nucleic acid to form a cleavage structure in the presence or absence of an INVADER oligonucleotide. When annealed to the target nucleic acid, the probe oligonucleotide and target form a cleavage structure and cleavage occurs within the probe oligonucleotide.

The term "non-target cleavage product" refers to a product of a cleavage reaction that is not derived from the target nucleic acid. As discussed above, in the methods of the present invention, cleavage of the cleavage structure generally occurs within the probe oligonucleotide. The fragments of the probe oligonucleotide generated by this target nucleic acid-dependent cleavage are "non-target cleavage products."

The term "INVADER oligonucleotide" refers to an oligonucleotide that hybridizes to a target nucleic acid at a location near the region of hybridization between a probe and the target nucleic acid, wherein the INVADER oligonucleotide comprises a portion (e.g., a chemical moiety, or nucleotide—whether complementary to that target or not) that overlaps with the region of hybridization between the probe and target. In some embodiments, the INVADER oligonucleotide contains sequences at its 3' end that are substantially the same as sequences located at the 5' end of a probe oligonucleotide.

The term "substantially single-stranded" when used in reference to a nucleic acid substrate means that the substrate molecule exists primarily as a single strand of nucleic acid in contrast to a double-stranded substrate which exists as two strands of nucleic acid which are held together by inter-strand base pairing interactions.

The term "sequence variation" as used herein refers to differences in nucleic acid sequence between two nucleic acids. For example, a wild-type structural gene and a mutant form of this wild-type structural gene may vary in sequence by the presence of single base substitutions and/or deletions or insertions of one or more nucleotides. These two forms of the structural gene are said to vary in sequence from one another. A second mutant form of the structural gene may exist. This second mutant form is said to vary in sequence from both the wild-type gene and the first mutant form of the gene.

The term "liberating" as used herein refers to the release of a nucleic acid fragment from a larger nucleic acid fragment, such as an oligonucleotide, by the action of, for example, a 5' nuclease such that the released fragment is no longer covalently attached to the remainder of the oligonucleotide.

The term "$K_m$" as used herein refers to the Michaelis-Menten constant for an enzyme and is defined as the concentration of the specific substrate at which a given enzyme yields one-half its maximum velocity in an enzyme catalyzed reaction.

The term "nucleotide" as used herein includes, but is not limited to, naturally occurring and/or synthetic nucleotides, nucleotide analogs, and nucleotide derivatives. For example, the term includes naturally occurring DNA or RNA monomers, nucleotides with backbone modifications such as peptide nucleic acid (PNA) (M. Egholm et al., Nature 365:566 [1993]), phosphorothioate DNA, phosphorodithioate DNA, phosphoramidate DNA, aminde-linked DNA, MMI-linked DNA, 2'-O-methyl RNA, alpha-DNA and methylphosphonate DNA, nucleotides with sugar modifications such as 2'-O-methyl RNA, 2'-fluoro RNA, 2'-amino RNA, 2'-O-alkyl DNA, 2'-O-allyl DNA, 2'-O-alkynyl DNA, hexose DNA, pyranosyl RNA, and anhydrohexitol DNA, and nucleotides having base modifications such as C-5 substituted pyrimidines (substituents including fluoro-, bromo- chloro-, iodo-, methyl-, ethyl-, vinyl-, formyl-, ethynyl-, propynyl-, alkynyl-, thiazoyl-, imidazolyl-, pyridyl-), 7-deazapurines with C-7 substituents including fluoro-, bromo-, chloro-, iodo-, methyl-, ethyl-, vinyl-, formyl-, alkynyl-, alkenyl-, thiazolyl-, imidazolyl-, pyridyl-), inosine and diaminopurine.

The term "base analog" as used herein refers to modified or non-naturally occurring bases such as 7-deaza purines (e.g., 7-deaza-adenine and 7-deaza-guanine); bases modified, for example, to provide altered interactions such as non-standard basepairing, including, but not limited to: IsoC, Iso G, and other modified bases and nucleotides described in U.S. Pat. Nos. 5,432,272; 6,001,983; 6,037,120; 6,140,496; 5,912,340; 6,127,121 and 6,143,877, each of which is incorporated herein by reference in their entireties; heterocyclic base analogs based no the purine or pyrimidine ring systems, and other heterocyclic bases. Nucleotide analogs include base analogs and comprise modified forms of deoxyribonucleotides as well as ribonucleotides.

The term "polymorphic locus" is a locus present in a population that shows variation between members of the population (e.g., the most common allele has a frequency of less than 0.95). In contrast, a "monomorphic locus" is a genetic locus at little or no variations seen between members of the population (generally taken to be a locus at which the most common allele exceeds a frequency of 0.95 in the gene pool of the population).

The term "microorganism" as used herein means an organism too small to be observed with the unaided eye and includes, but is not limited to bacteria, virus, protozoans, fungi, and ciliates.

The term "microbial gene sequences" refers to gene sequences derived from a microorganism.

The term "bacteria" refers to any bacterial species including eubacterial and archaebacterial species.

The term "virus" refers to obligate, ultramicroscopic, intracellular parasites incapable of autonomous replication (i.e., replication requires the use of the host cell's machinery).

The term "multi-drug resistant" or multiple-drug resistant" refers to a microorganism that is resistant to more than one of the antibiotics or antimicrobial agents used in the treatment of said microorganism.

The term "sample" in the present specification and claims is used in its broadest sense. On the one hand it is meant to include a specimen or culture (e.g., microbiological cultures). On the other hand, it is meant to include both biological and environmental samples. A sample may include a specimen of synthetic origin.

Biological samples may be animal, including human, fluid, solid (e.g., stool) or tissue, as well as liquid and solid food and feed products and ingredients such as dairy items, vegetables, meat and meat by-products, and waste. Biological samples may be obtained from all of the various families of domestic animals, as well as feral or wild animals, including, but not limited to, such animals as ungulates, bear, fish, lagamorphs, rodents, etc.

Environmental samples include environmental material such as surface matter, soil, water and industrial samples, as well as samples obtained from food and dairy processing instruments, apparatus, equipment, utensils, disposable and non-disposable items. These examples are not to be construed as limiting the sample types applicable to the present invention.

The term "source of target nucleic acid" refers to any sample that contains nucleic acids (RNA or DNA). Particularly preferred sources of target nucleic acids are biological samples including, but not limited to blood, saliva, cerebral spinal fluid, pleural fluid, milk, lymph, sputum and semen.

An oligonucleotide is said to be present in "excess" relative to another oligonucleotide (or target nucleic acid sequence) if that oligonucleotide is present at a higher molar concentration that the other oligonucleotide (or target nucleic acid sequence). When an oligonucleotide such as a probe oligonucleotide is present in a cleavage reaction in excess relative to the concentration of the complementary target nucleic acid sequence, the reaction may be used to indicate the amount of the target nucleic acid present. Typically, when present in excess, the probe oligonucleotide will be present at least a 100-fold molar excess; typically at least 1 pmole of each probe oligonucleotide would be used when the target nucleic acid sequence was present at about 10 fmoles or less.

A sample "suspected of containing" a first and a second target nucleic acid may contain either, both or neither target nucleic acid molecule.

The term "charge-balanced" oligonucleotide refers to an oligonucleotide (the input oligonucleotide in a reaction) that has been modified such that the modified oligonucleotide bears a charge, such that when the modified oligonucleotide is either cleaved (i.e., shortened) or elongated, a resulting product bears a charge different from the input oligonucleotide (the "charge-unbalanced" oligonucleotide) thereby permitting separation of the input and reacted oligonucleotides on the basis of charge. The term "charge-balanced" does not imply that the modified or balanced oligonucleotide has a net neutral charge (although this can be the case). Charge-balancing refers to the design and modification of an oligonucleotide such that a specific reaction product generated from this input oligonucleotide can be separated on the basis of charge from the input oligonucleotide.

For example, in an INVADER oligonucleotide-directed cleavage assay in which the probe oligonucleotide bears the sequence: 5' TTCTTTTCACCAGCGAGACGGG 3' (i.e., SEQ ID NO:136 without the modified bases) and cleavage of the probe occurs between the second and third residues, one possible charge-balanced version of this oligonucleotide would be: 5' Cy3-AminoT-Amino-TCTTTTCACCAGC-GAGAC GGG 3'. This modified oligonucleotide bears a net negative charge. After cleavage, the following oligonucleotides are generated: 5' Cy3-AminoT-Amino-T 3' and 5' CTTTTCACCAGCGAGACGGG 3' (residues 3–22 of SEQ ID NO:136). 5' Cy3-AminoT-Amino-T 3' bears a detectable moiety (the positively-charged Cy3 dye) and two amino-modified bases. The amino-modified bases and the Cy3 dye contribute positive charges in excess of the negative charges contributed by the phosphate groups and thus the 5' Cy3-AminoT-Amino-T 3'oligonucleotide has a net positive charge. The other, longer cleavage fragment, like the input probe, bears a net negative charge. Because the 5' Cy3-AminoT-Amino-T 3' fragment is separable on the basis of charge from the input probe (the charge-balanced oligonucleotide), it is referred to as a charge-unbalanced oligonucleotide. The longer cleavage product cannot be separated on the basis of charge from the input oligonucleotide as both oligonucleotides bear a net negative charge; thus, the longer cleavage product is not a charge-unbalanced oligonucleotide.

The term "net neutral charge" when used in reference to an oligonucleotide, including modified oligonucleotides, indicates that the sum of the charges present (i.e., R—NH3+ groups on thymidines, the N3 nitrogen of cytosine, presence or absence or phosphate groups, etc.) under the desired reaction or separation conditions is essentially zero. An oligonucleotide having a net neutral charge would not migrate in an electrical field.

The term "net positive charge" when used in reference to an oligonucleotide, including modified oligonucleotides, indicates that the sum of the charges present (i.e., R—NH3+ groups on thymidines, the N3 nitrogen of cytosine, presence or absence or phosphate groups, etc.) under the desired reaction conditions is +1 or greater. An oligonucleotide having a net positive charge would migrate toward the negative electrode in an electrical field.

The term "net negative charge" when used in reference to an oligonucleotide, including modified oligonucleotides, indicates that the sum of the charges present (i.e., R—NH3+ groups on thymidines, the N3 nitrogen of cytosine, presence or absence or phosphate groups, etc.) under the desired reaction conditions is −1 or lower. An oligonucleotide having a net negative charge would migrate toward the positive electrode in an electrical field.

The term "polymerization means" or "polymerization agent" refers to any agent capable of facilitating the addition of nucleoside triphosphates to an oligonucleotide. Preferred polymerization means comprise DNA and RNA polymerases.

The term "ligation means" or "ligation agent" refers to any agent capable of facilitating the ligation (i.e., the formation of a phosphodiester bond between a 3'-OH and a 5' P located at the termini of two strands of nucleic acid). Preferred ligation means comprise DNA ligases and RNA ligases.

The term "reactant" is used herein in its broadest sense. The reactant can comprise, for example, an enzymatic reactant, a chemical reactant or light (e.g., ultraviolet light, particularly short wavelength ultraviolet light is known to break oligonucleotide chains). Any agent capable of reacting with an oligonucleotide to either shorten (i.e., cleave) or elongate the oligonucleotide is encompassed within the term "reactant."

The term "adduct" is used herein in its broadest sense to indicate any compound or element that can be added to an oligonucleotide. An adduct may be charged (positively or negatively) or may be charge-neutral. An adduct may be added to the oligonucleotide via covalent or non-covalent linkages. Examples of adducts include, but are not limited to, indodicarbocyanine dye amidites, amino-substituted nucleotides, ethidium bromide, ethidium homodimer, (1,3-propanediamino)propidium, (diethylenetriamino)propidium, thiazole orange, (N-N'-tetramethyl-1,3-propanediamino)propyl thiazole orange, (N-N'-tetramethyl-1,2-ethanediamino)propyl thiazole orange, thiazole orange-thiazole orange homodimer (TOTO), thiazole orange-thiazole blue heterodimer (TOTAB), thiazole orange-ethidium heterodimer 1 (TOED1), thiazole orange-ethidium heterodimer 2 (TOED2) and fluorescein-ethidium heterodimer (FED), psoralens, biotin, streptavidin, avidin, etc.

Where a first oligonucleotide is complementary to a region of a target nucleic acid and a second oligonucleotide has complementary to the same region (or a portion of this region) a "region of sequence overlap" exists along the target nucleic acid. The degree of overlap will vary depending upon the nature of the complementarity (see, e.g., region "X" in FIGS. 29 and 67 and the accompanying discussions).

As used herein, the term "purified" or "to purify" refers to the removal of contaminants from a sample. For example, recombinant CLEAVASE nucleases are expressed in bacterial host cells and the nucleases are purified by the removal of host cell proteins; the percent of these recombinant nucleases is thereby increased in the sample.

The term "recombinant DNA molecule" as used herein refers to a DNA molecule that comprises of segments of DNA joined together by means of molecular biological techniques.

The term "recombinant protein" or "recombinant polypeptide" as used herein refers to a protein molecule that is expressed from a recombinant DNA molecule.

As used herein the term "portion" when in reference to a protein (as in "a portion of a given protein") refers to fragments of that protein. The fragments may range in size from four amino acid residues to the entire amino acid sequence minus one amino acid (e.g., 4, 5, 6, . . . , n−1).

The term "nucleic acid sequence" as used herein refers to an oligonucleotide, nucleotide or polynucleotide, and fragments or portions thereof, and to DNA or RNA of genomic or synthetic origin that may be single or double stranded, and represent the sense or antisense strand. Similarly, "amino acid sequence" as used herein refers to peptide or protein sequence.

The term "peptide nucleic acid" ("PNA") as used herein refers to a molecule comprising bases or base analogs such as would be found in natural nucleic acid, but attached to a peptide backbone rather than the sugar-phosphate backbone typical of nucleic acids. The attachment of the bases to the peptide is such as to allow the bases to base pair with complementary bases of nucleic acid in a manner similar to that of an oligonucleotide. These small molecules, also designated anti gene agents, stop transcript elongation by binding to their complementary strand of nucleic acid (Nielsen, et al. Anticancer Drug Des. 8:53 63 [1993]).

As used herein, the terms "purified" or "substantially purified" refer to molecules, either nucleic or amino acid sequences, that are removed from their natural environment, isolated or separated, and are at least 60% free, preferably 75% free, and most preferably 90% free from other components with which they are naturally associated. An "isolated polynucleotide" or "isolated oligonucleotide" is therefore a substantially purified polynucleotide.

As used herein, the term "fusion protein" refers to a chimeric protein containing the protein of interest (e.g., CLEAVASE BN/thrombin nuclease and portions or fragments thereof) joined to an exogenous protein fragment (the fusion partner which consists of a non CLEAVASE BN/thrombin nuclease protein). The fusion partner may enhance solubility of recombinant chimeric protein (e.g., the CLEAVASE BN/thrombin nuclease) as expressed in a host cell, may provide an affinity tag (e.g., a his-tag) to allow purification of the recombinant fusion protein from the host cell or culture supernatant, or both. If desired, the fusion protein may be removed from the protein of interest (e.g., CLEAVASE BN/thrombin nuclease or fragments thereof) by a variety of enzymatic or chemical means known to the art.

As used herein, the terms "chimeric protein" and "chimerical protein" refer to a single protein molecule that comprises amino acid sequences portions derived from two or more parent proteins. These parent molecules may be from similar proteins from genetically distinct origins, different proteins from a single organism, or different proteins from different organisms. By way of example but not by way of limitation, a chimeric structure-specific nuclease of the present invention may contain a mixture of amino acid sequences that have been derived from FEN-1 genes from two or more of the organisms having such genes, combined to form a non-naturally occurring nuclease. The term "chimerical" as used herein is not intended to convey any particular proportion of contribution from the naturally occurring genes, nor limit the manner in which the portions are combined. Any chimeric structure-specific nuclease constructs having cleavage activity as determined by the testing methods described herein are improved cleavage agents within the scope of the present invention.

The term "continuous strand of nucleic acid" as used herein is means a strand of nucleic acid that has a continuous, covalently linked, backbone structure, without nicks or other disruptions. The disposition of the base portion of each nucleotide, whether base-paired, single-stranded or mismatched, is not an element in the definition of a continuous strand. The backbone of the continuous strand is not limited to the ribose-phosphate or deoxyribose-phosphate compositions that are found in naturally occurring, unmodified nucleic acids. A nucleic acid of the present invention may comprise modifications in the structure of the backbone, including but not limited to phosphorothioate residues, phosphonate residues, 2' substituted ribose residues (e.g., 2'-O-methyl ribose) and alternative sugar (e.g., arabinose) containing residues.

The term "continuous duplex" as used herein refers to a region of double stranded nucleic acid in which there is no disruption in the progression of basepairs within the duplex (i.e., the base pairs along the duplex are not distorted to accommodate a gap, bulge or mismatch with the confines of the region of continuous duplex). As used herein the term refers only to the arrangement of the basepairs within the duplex, without implication of continuity in the backbone portion of the nucleic acid strand. Duplex nucleic acids with uninterrupted basepairing, but with nicks in one or both strands are within the definition of a continuous duplex.

The term "duplex" refers to the state of nucleic acids in which the base portions of the nucleotides on one strand are bound through hydrogen bonding the their complementary bases arrayed on a second strand. The condition of being in a duplex form reflects on the state of the bases of a nucleic acid. By virtue of base pairing, the strands of nucleic acid also generally assume the tertiary structure of a double helix, having a major and a minor groove. The assumption of the helical form is implicit in the act of becoming duplexed.

The term "duplex dependent protein binding" refers to the binding of proteins to nucleic acid that is dependent on the nucleic acid being in a duplex, or helical form.

The term "duplex dependent protein binding sites or regions" as used herein refers to discrete regions or sequences within a nucleic acid that are bound with particular affinity by specific duplex-dependent nucleic acid binding proteins. This is in contrast to the generalized duplex-dependent binding of proteins that are not site-specific, such as the histone proteins that bind chromatin with little reference to specific sequences or sites.

The term "protein-binding region" as used herein refers to a nucleic acid region identified by a sequence or structure as binding to a particular protein or class of proteins. It is within the scope of this definition to include those regions that contain sufficient genetic information to allow identifications of the region by comparison to known sequences, but which might not have the requisite structure for actual binding (e.g., a single strand of a duplex-depending nucleic acid binding protein site). As used herein "protein binding region" excludes restriction endonuclease binding regions.

The term "complete double stranded protein binding region" as used herein refers to the minimum region of continuous duplex required to allow binding or other activity of a duplex-dependent protein. This definition is intended to encompass the observation that some duplex dependent nucleic acid binding proteins can interact with full activity with regions of duplex that may be shorter than a canonical protein binding region as observed in one or the other of the two single strands. In other words, one or more nucleotides in the region may be allowed to remain unpaired without suppressing binding. As used here in, the term "complete double stranded binding region" refers to the minimum sequence that will accommodate the binding function. Because some such regions can tolerate non-duplex sequences in multiple places, although not necessarily simultaneously, a single protein binding region might have several shorter sub-regions that, when duplexed, will be fully competent for protein binding.

The term "template" refers to a strand of nucleic acid on which a complementary copy is built from nucleoside triphosphates through the activity of a template-dependent nucleic acid polymerase. Within a duplex the template strand is, by convention, depicted and described as the "bottom" strand. Similarly, the non-template strand is often depicted and described as the "top" strand.

The term "template-dependent RNA polymerase" refers to a nucleic acid polymerase that creates new RNA strands through the copying of a template strand as described above and which does not synthesize RNA in the absence of a template. This is in contrast to the activity of the template-independent nucleic acid polymerases that synthesize or extend nucleic acids without reference to a template, such as terminal deoxynucleotidyl transferase, or Poly A polymerase.

The term "ARRESTOR molecule" refers to an agent added to or included in an invasive cleavage reaction in order to stop one or more reaction components from participating in a subsequent action or reaction. This may be done by sequestering or inactivating some reaction component (e.g., by binding or base-pairing a nucleic acid component, or by binding to a protein component). The term "ARRESTOR oligonucleotide" refers to an oligonucleotide included in an invasive cleavage reaction in order to stop or arrest one or more aspects of any reaction (e.g., the first reaction and/or any subsequent reactions or actions; it is not intended that the ARRESTOR oligonucleotide be limited to any particular reaction or reaction step). This may be done by sequestering some reaction component (e.g., base-pairing to another nucleic acid, or binding to a protein component). However, it is not intended that the term be so limited as to just situations in which a reaction component is sequestered.

As used herein, the term "kit" refers to any delivery system for delivering materials. In the context of reaction assays, such delivery systems include systems that allow for the storage, transport, or delivery of reaction reagents (e.g., oligonucleotides, enzymes, etc. in the appropriate containers) and/or supporting materials (e.g., buffers, written instructions for performing the assay etc.) from one location to another. For example, kits include one or more enclosures (e.g., boxes) containing the relevant reaction reagents and/or supporting materials. As used herein, the term "fragmented kit" refers to a delivery systems comprising two or more separate containers that each contain a subportion of the total kit components. The containers may be delivered to the intended recipient together or separately. For example, a first container may contain an enzyme for use in an assay, while a second container contains oligonucleotides. The term "fragmented kit" is intended to encompass kits containing Analyte specific reagents (ASR's) regulated under section 520(e) of the Federal Food, Drug, and Cosmetic Act, but are not limited thereto. Indeed, any delivery system comprising two or more separate containers that each contains a sub-portion of the total kit components are included in the term "fragmented kit." In contrast, a "combined kit" refers to a delivery system containing all of the components of a reaction assay in a single container (e.g., in a single box housing each of the desired components). The term "kit" includes both fragmented and combined kits.

As used herein, the term "functional domain" refers to a region, or a part of a region, of a protein (e.g., an enzyme) that provides one or more functional characteristic of the protein. For example, a functional domain of an enzyme may provide, directly or indirectly, one or more activities of the enzyme including, but not limited to, substrate binding capability and catalytic activity. A functional domain may be characterized through mutation of one or more amino acids within the functional domain, wherein mutation of the amino acid(s) alters the associated functionality (as measured empirically in an assay) thereby indicating the presence of a functional domain.

As used herein, the term "heterologous functional domain" refers to a protein functional domain that is not in its natural environment. For example, a heterologous functional domain includes a functional domain from one enzyme introduced into another enzyme. A heterologous functional domain also includes a functional domain native to a protein that has been altered in some way (e.g., mutated, added in multiple copies, etc.). A heterologous functional domain may comprise a plurality of contiguous amino acids or may include two or more distal amino acids are amino acids fragments (e.g., two or more amino acids or fragments with intervening, non-heterologous, sequence). Heterologous functional domains are distinguished from endogenous functional domains in that the heterologous amino acid(s) are joined to or contain amino acid sequences that are not found naturally associated with the amino acid sequence in nature or are associated with a portion of a protein not found in nature.

As used herein, the term "altered functionality in a nucleic acid cleavage assay" refers to a characteristic of an enzyme that has been altered in some manner to differ from its natural state (e.g., to differ from how it is found in nature). Alterations include, but are not limited to, addition of a heterologous functional domain (e.g., through mutation or through creation of chimerical proteins). In some embodiments, the altered characteristic of the enzyme may be one that improves the performance of an enzyme in a nucleic acid cleavage assay. Types of improvement include, but are not limited to, improved nuclease activity (e.g., improved rate of reaction), improved substrate binding (e.g., increased or decreased binding of certain nucleic acid species [e.g., RNA or DNA] that produces a desired outcome [e.g., greater specificity, improved substrate turnover, etc.]), and improved background specificity (e.g., less undesired product is produced). The present invention is not limited by the nucleic cleavage assay used to test improved functionality. However, in some preferred embodiments of the present invention, an invasive cleavage assay is used as the nucleic acid cleavage assay. In certain particularly preferred embodiments, an invasive cleavage assay utilizing an RNA target is used as the nucleic acid cleavage assay.

As used herein, the terms "N-terminal" and "C-terminal" in reference to polypeptide sequences refer to regions of polypeptides including portions of the N-terminal and C-terminal regions of the polypeptide, respectively. A sequence that includes a portion of the N-terminal region of polypeptide includes amino acids predominantly from the N-terminal half of the polypeptide chain, but is not limited to such sequences. For example, an N-terminal sequence may include an interior portion of the polypeptide sequence including bases from both the N-terminal and C-terminal halves of the polypeptide. The same applies to C-terminal regions. N-terminal and C-terminal regions may, but need not, include the amino acid defining the ultimate N-terminal and C-terminal ends of the polypeptide, respectively.

DESCRIPTION OF THE DRAWINGS

Figure 8A:
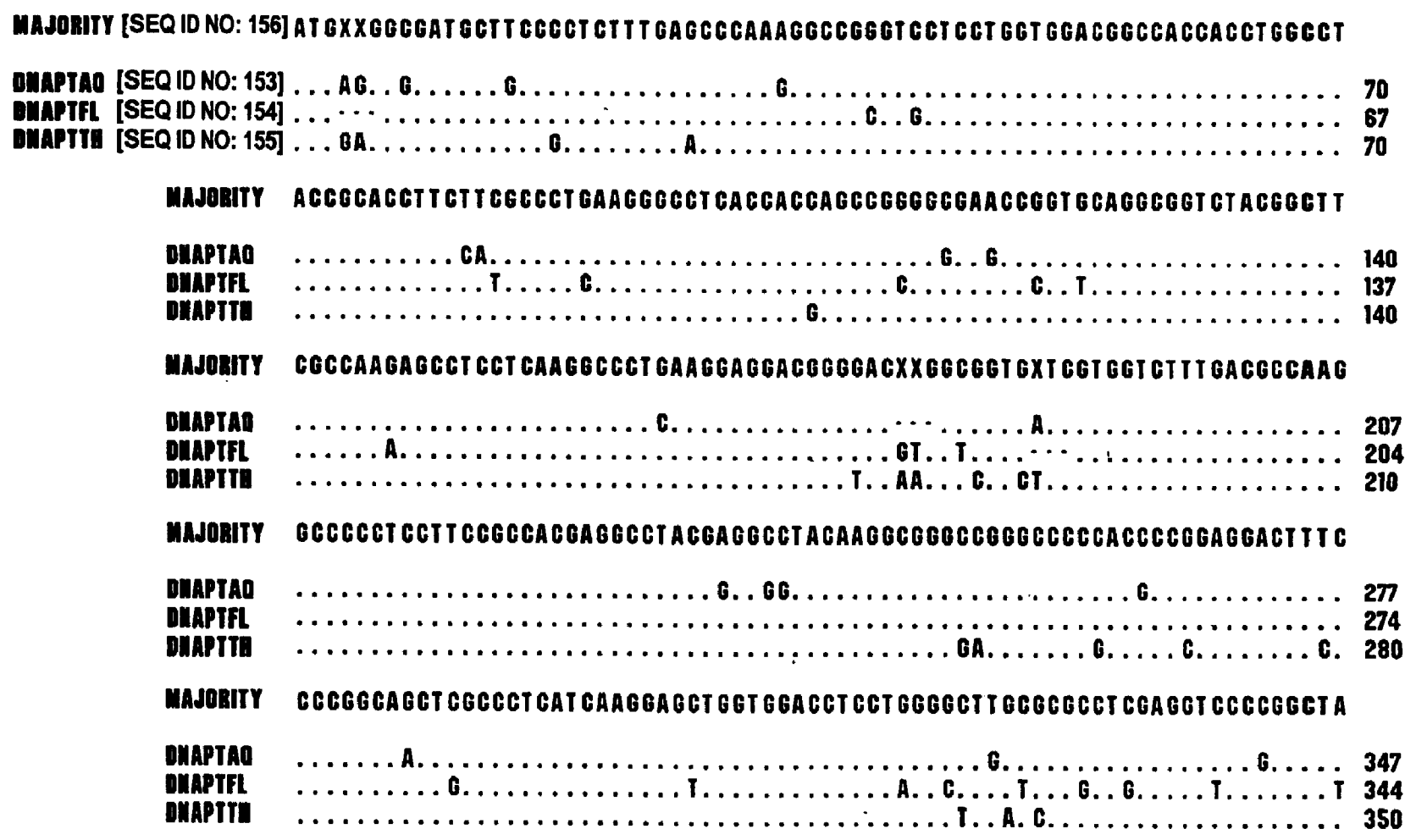
Figure 8B:
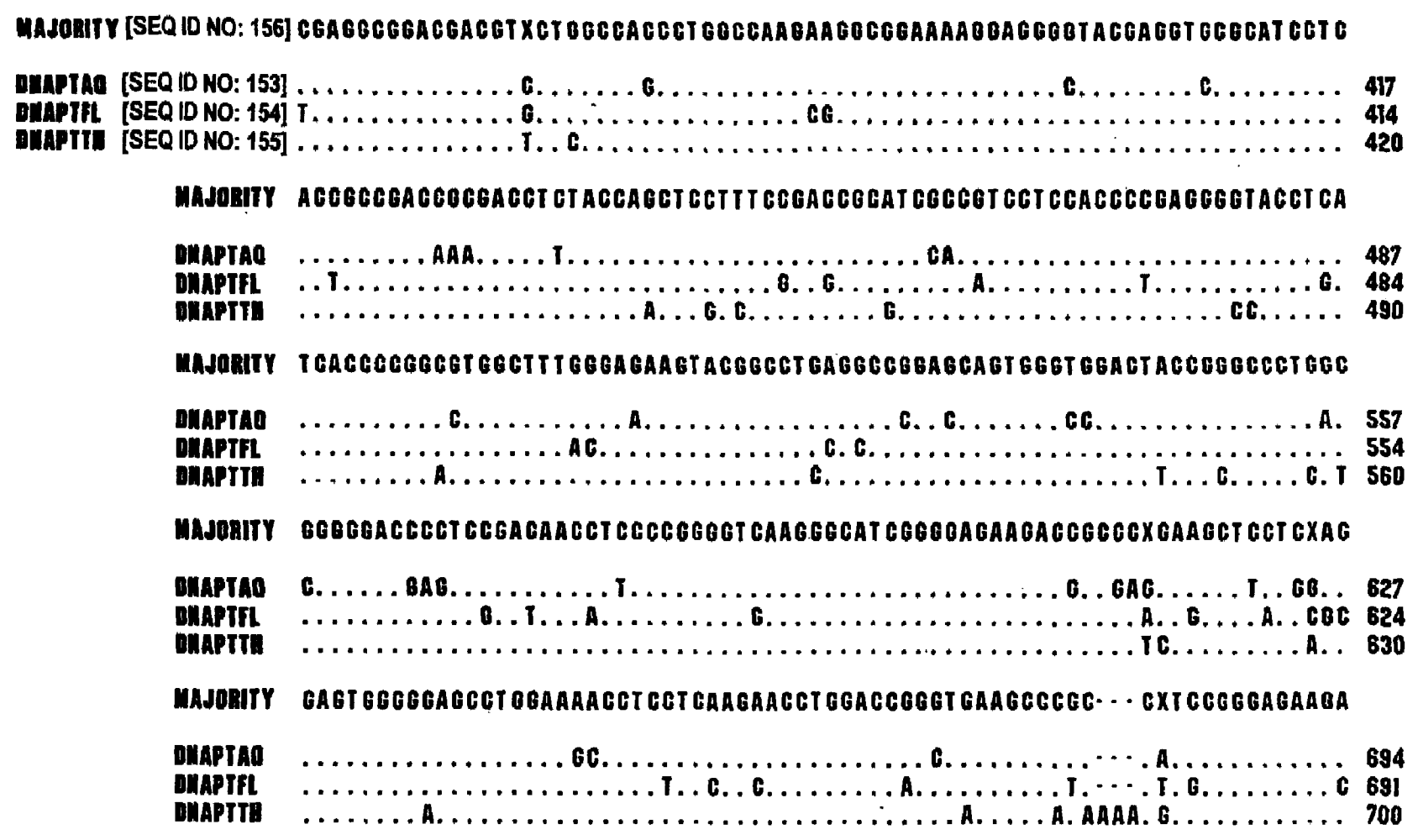
Figure 8C:
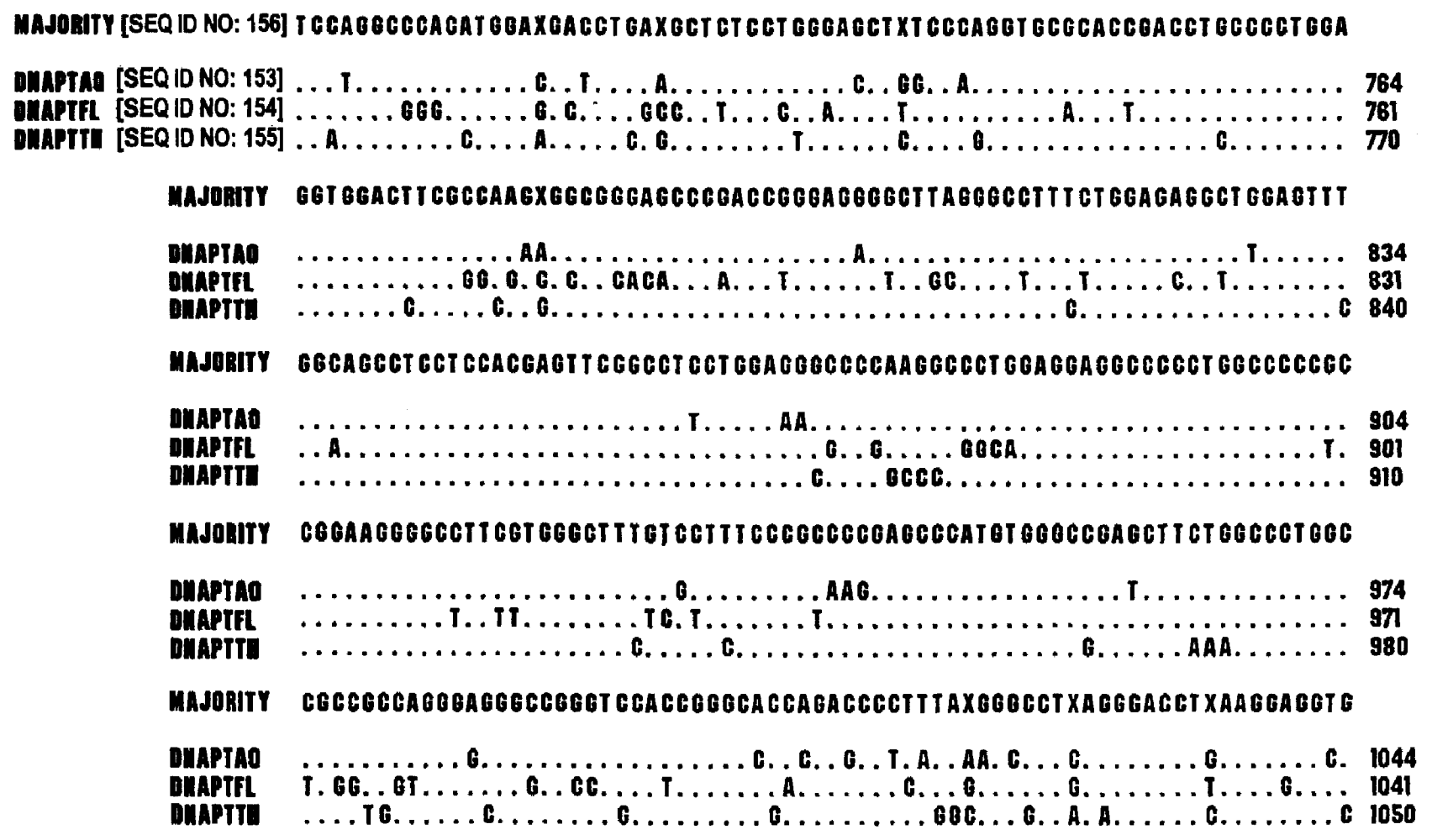
Figure 8D:
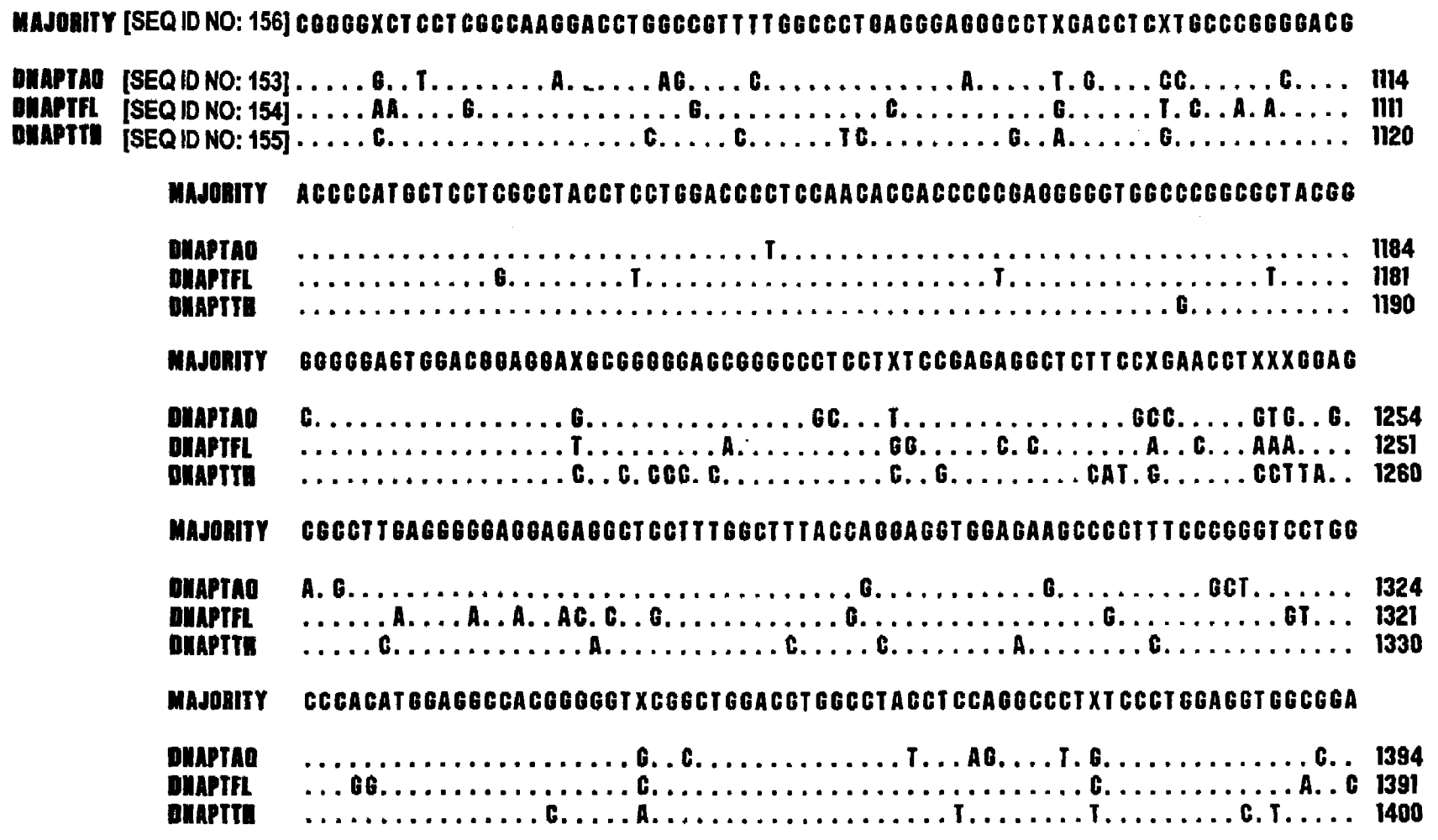
Figure 8E:
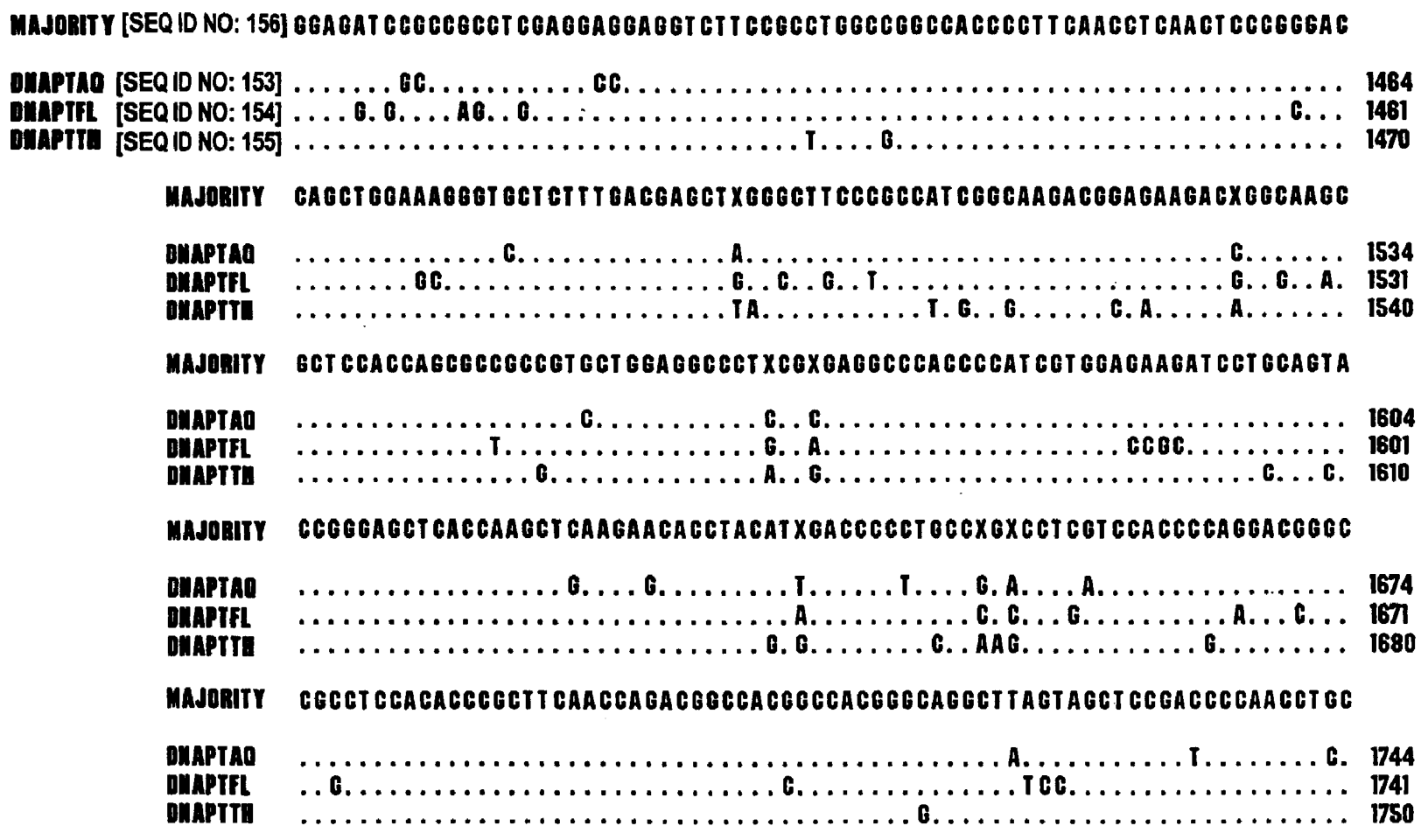
Figure 8G:
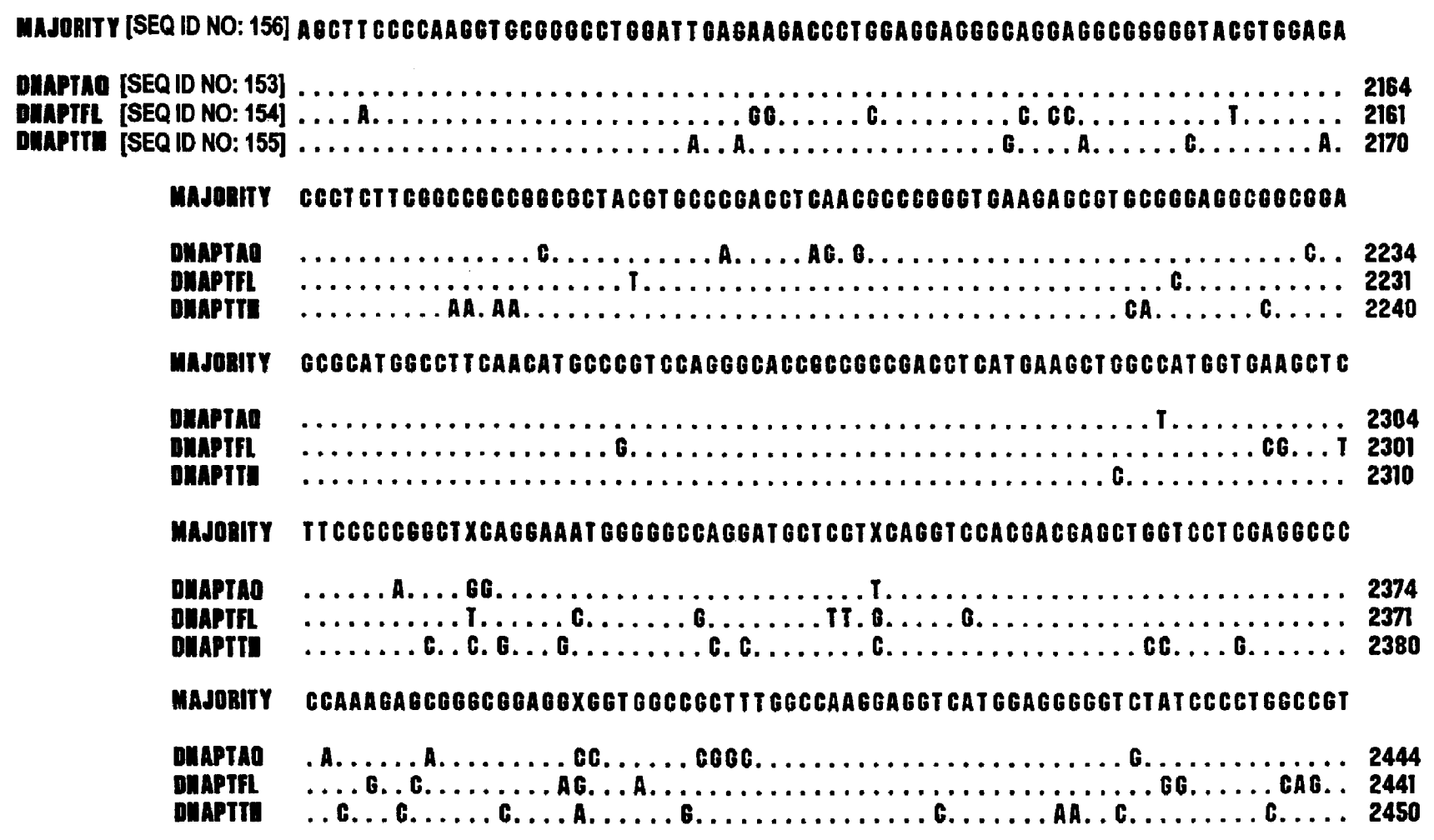

FIG. 8A-H shows a comparison of the nucleotide structure of the polymerase genes isolated from *Thermus aquaticus* (SEQ ID NO:153), *Thermus flavus* (SEQ ID NO:154) and *Thermus thermophilus* (SEQ ID NO:155); the consensus sequence (SEQ ID NO:156) is shown at the top of each row.

FIG. 9A–C shows a comparison of the amino acid sequence of the polymerase isolated from *Thermus aquaticus* (SEQ ID NO:157), *Thermus flavus* (SEQ ID NO:158), and *Thermus thermophilus* (SEQ ID NO:1); the consensus sequence (SEQ ID NO:159) is shown at the top of each row.

FIG. 13 shows a comparison of the amino acid sequences of the BstI-BamHI fragments of TaqPol (SEQ ID NO:164) and TthPol (SEQ ID NO:165). Pairs of similar amino acids are shaded with light gray. Aligned amino acids that have a charge difference are shaded with dark gray. The numbers correspond to the amino acid sequence of TaqPol. Amino acids of TaqPol changed to the corresponding amino acids of TthPol by site-directed mutagenesis are indicated by (+).

FIG. 16 compares polymerization activities of TaqPol, TthPol, and Taq-Tth chimerical enzymes, and TaqPol having the indicated amino acid modifications.

FIGS. 18A–D show schematic diagrams of examples of substrates that may be used to measure various cleavage activities of enzymes. The substrates may be labeled, for example, with a fluorescent dye and a quenching moiety for FRET detection, as shown, to facilitate detection and measurement. The substrates of 18A and 18B are invasive cleavage structures having RNA and DNA target strands, respectively. 18C shows an example of an X-structure, and 18D shows an example of a hairpin structure, both of which may be used to assess the activity of enzymes on alternative structures that may be present in invasive cleavage reactions.

FIG. 21 shows schematic diagrams for model substrates used to test enzymes for invasive cleavage activity. The molecule shown in 21A provides a DNA target strand (SEQ ID NO:168), while the model shown in 21B provides an RNA containing target strand (SEQ ID NO:167). Both 21A and B show downstream probe SEQ ID NO:166.

FIGS. 22A and 22B show schematic diagrams for model substrates used to test enzymes for cleavage activity on alternative, non-invasive structures.

FIGS. 24A and 24B show schematic diagrams for a model substrate used to test enzymes for invasive cleavage activity on RNA or DNA target strands.

FIG. 26 displays the sequence of oligonucleotide 89-15-1 (SEQ ID NO:212), oligonucleotide 81-69-5 (SEQ ID NO:213), oligonucleotide 81-69-4 (SEQ ID NO:214), oligonucleotide 81-69-3 (SEQ ID NO:215), oligonucleotide 81-69-2 (SEQ ID NO:216) and a portion of M13mp18 (SEQ ID NO:217).

FIG. 28a shows the image generated by a fluorescence imager that compares the amount of product generated in a standard (i.e., a non-sequential invasive cleavage reaction) and a sequential invasive cleavage reaction.

FIG. 28b is a graph comparing the amount of product generated in a standard or basic (i.e., a non-sequential invasive cleavage reaction) and a sequential invasive cleavage reaction ("INVADER sqrd") (y axis=fluorescence units; x axix=attomoles of target).

FIG. 30 shows the sequence of oligonucleotide 89-76 (SEQ ID NO:218), oligonucleotide 89-44 (SEQ ID NO:219) and nucleotides 3057–3110 of the HCMV genome (SEQ ID NO:220).

FIG. 40 shows an example microplate layout for an RNA INVADER assay comprising 40 samples, 6 standards, and a No Target Control.

FIG. 41 shows INVADER assay components for use in detecting human (h), mouse (m), or rat (r) RNAs of the indicated genes or transcripts.

FIG. 47 shows INVADER assay components (SEQ ID NOs:709–2640) for use in detecting RNA target nucleic acids. These assay components can also be used in the detection of cDNA or DNA copies of the RNA targets. Components are grouped per RNA analyte to be detected. Where multiple probes, INVADER oligonucleotides, stacker oligonucleotides, ARRESTOR oligonucleotides, or other components are provided, any of the multiple components may be used, unless indicated otherwise. Unless indicated otherwise, oligonucleotides are presented 5'-3' orientation.

FIG. 48 shows a chart showing the Ave(10) Index against base pair position.

FIG. 49 shows INVADER assay components (SEQ ID NOs:2868–4004) for use in detecting RNA target nucleic acids. These assay components can also be used in the detection of cDNA or DNA copies of the RNA targets. Components are grouped per RNA analyte to be detected. Where multiple probes, INVADER oligonucleotides, stacker oligonucleotides, ARRESTOR oligonucleotides, or other components are provided, any of the multiple components may be used, unless indicated otherwise. Unless indicated otherwise, oligonucleotides are presented 5'-3' orientation. All primary probes (i.e., oligonucleotides indicated as "Probes" that are not part of a Secondary System) include a 3' amine (this may or may not be indicated), unless another chemistry is specifically identified. Natural bases are designated with upper case characters, and 2' O-methylated bases are designated with lower case characters.

DESCRIPTION OF THE INVENTION

Introduction

Figure 1:
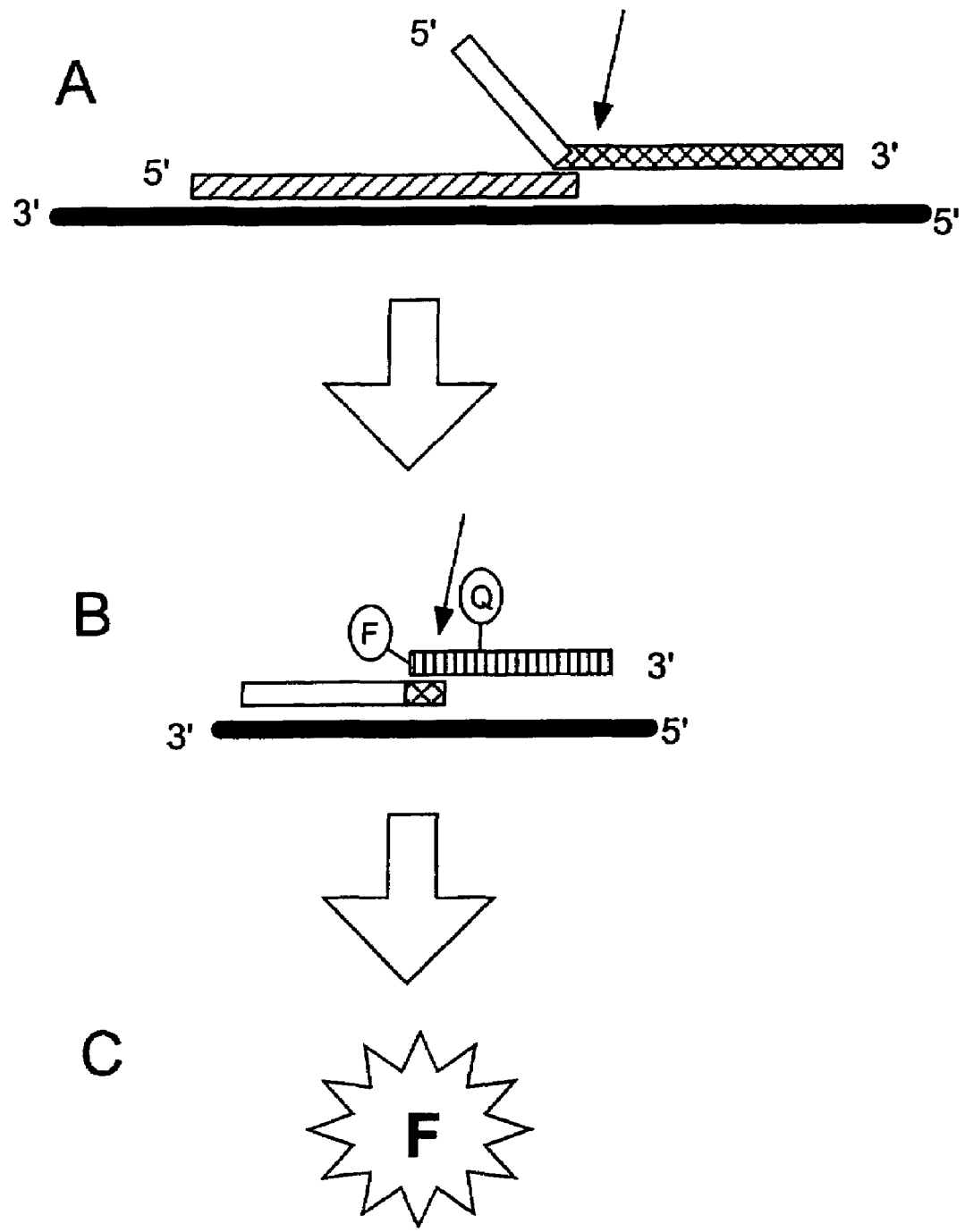
FIG. 1 shows a schematic representation of sequential invasive cleavage reactions. In step A, an upstream INVADER oligonucleotide and a downstream probe combine with a target nucleic acid strand to form a cleavage structure. In step B, the portion of the cleaved signal probe from A combines with a second target nucleic acid strand and a labeled signal probe to form a second cleavage structure. In step C, cleavage of the labeled second cleavage structure yields a detectable signal.
Figure 2:
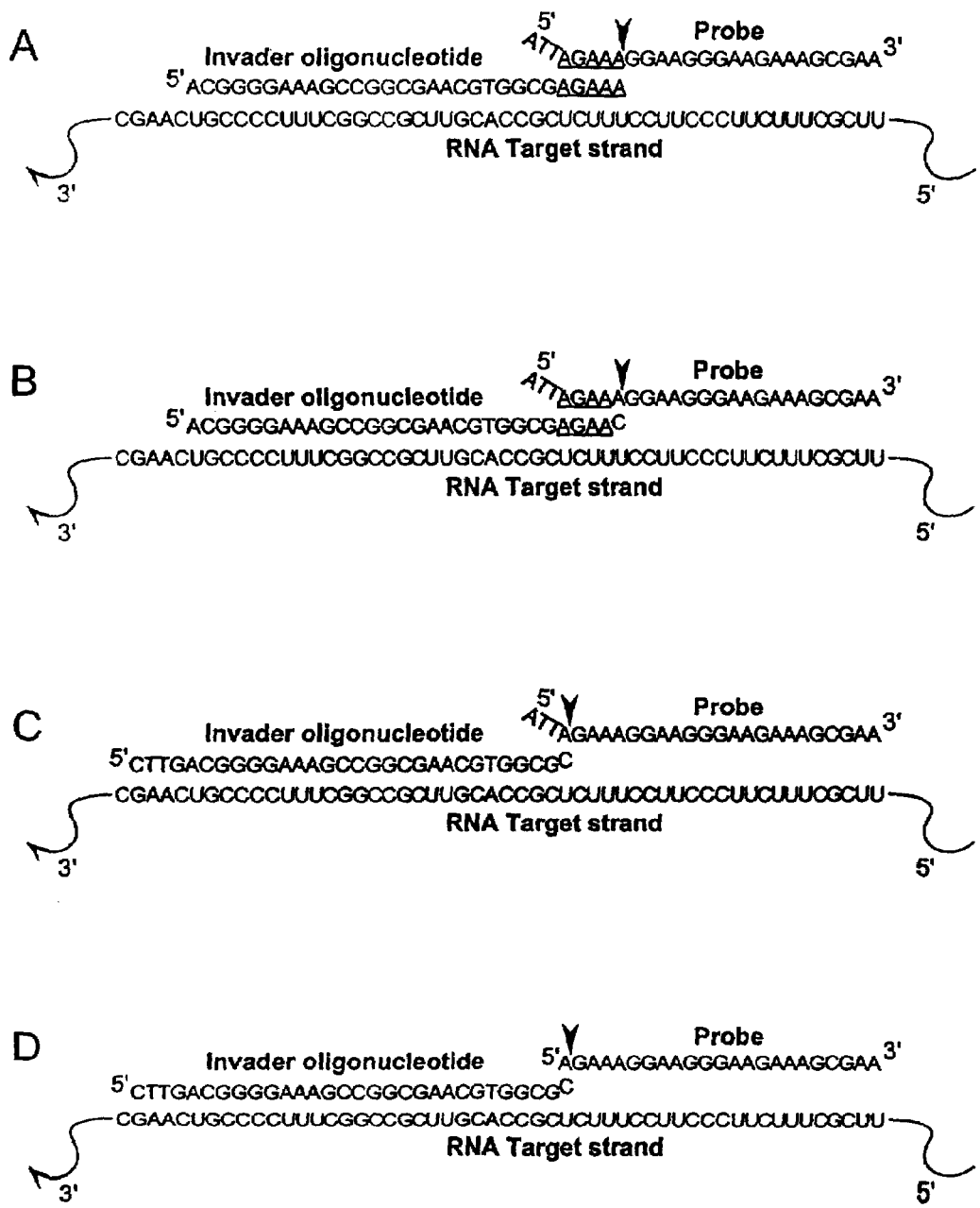
FIG. 2 shows schematic representations of several examples of invasive cleavage structures comprising RNA target strands (SEQ ID NO:141). Panel A depicts an INVADER oligonucleotide (SEQ ID NO:142) and probe (SEQ ID NO:143). Panel B depicts an INVADER oligonucleotide (SEQ ID NO:144) and probe (SEQ ID NO:143). Panel C depicts an INVADER oligonucleotide (SEQ ID NO:145) and probe (SEQ ID NO:145). Panel D depicts an INVADER oligonucleotide (SEQ ID NO:145) and probe (SEQ ID NO:146).
Figure 3:
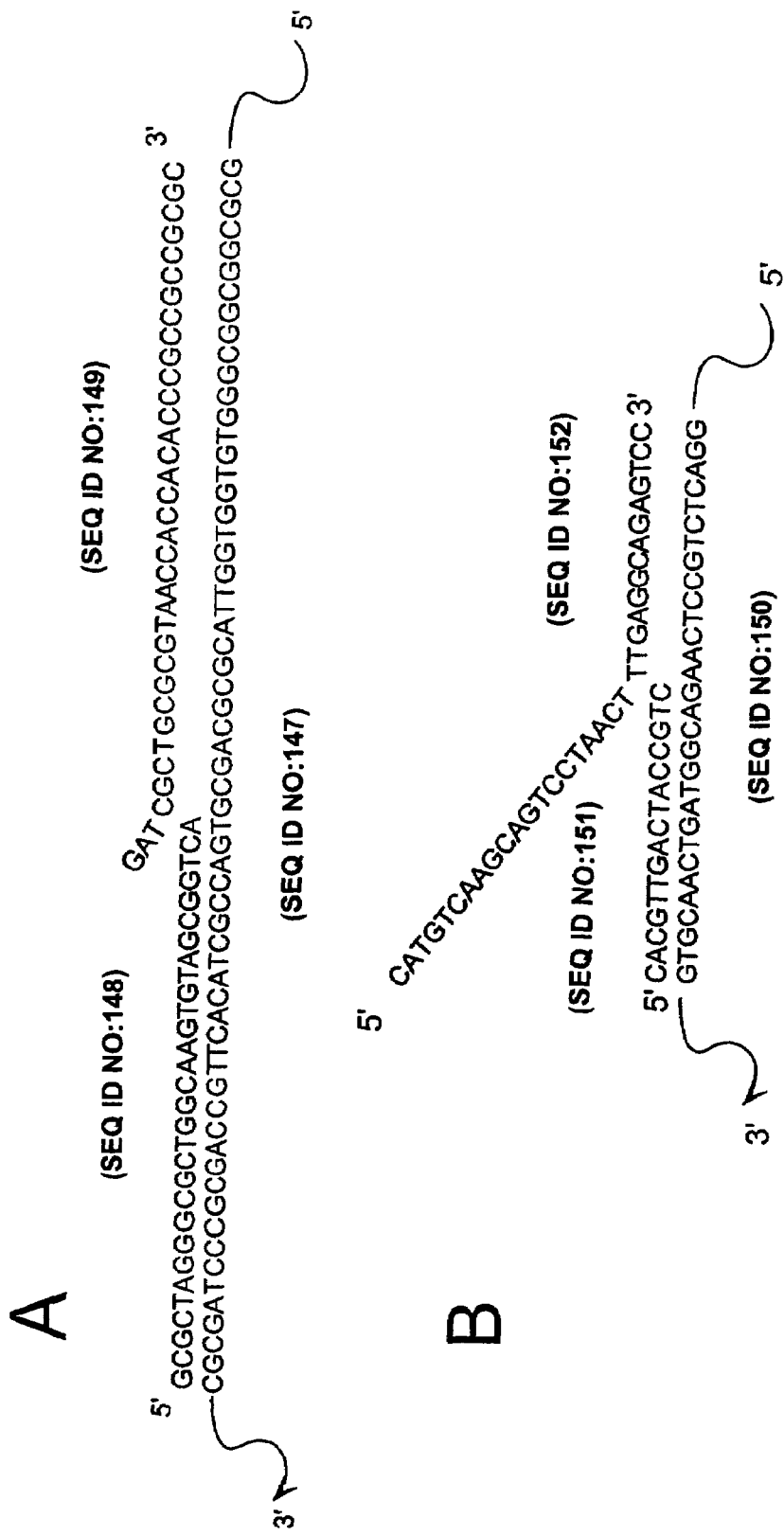
FIG. 3 shows schematic representations of two examples of structures that are not invasive cleavage structures labelled SEQ ID NOs:147–152.
Figure 4:
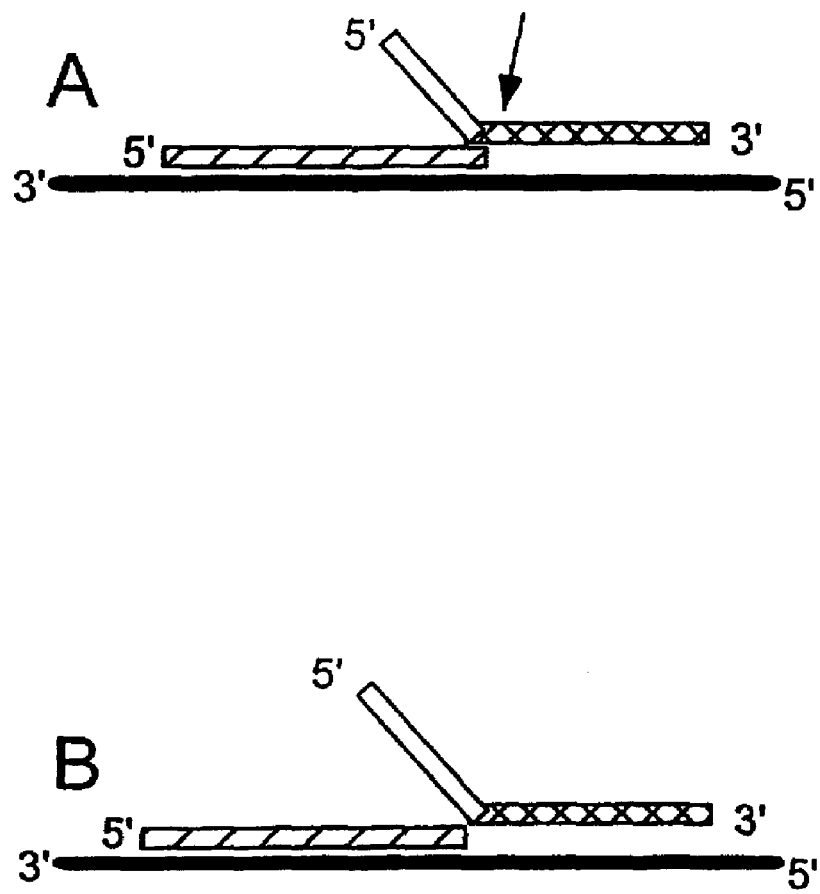
FIG. 4 shows a schematic representation of a configuration of invasive cleavage that is useful for detection of target sequence variations. In A, an invasive cleavage structure having overlap between the two probes is formed, and the arrow indicates that it is cleavable by the enzymes of the present invention. In B, variation of the target sequence removes a region of complementarity to the downstream probe and eliminates the overlap. The absence of an arrow in panel B indicates a reduced rate of cleavage of this structure compared to that diagrammed in panel A.

The present invention relates to methods and compositions for treating nucleic acid, and in particular, methods and compositions for detection and characterization of nucleic acid sequences and sequence changes.

In preferred embodiments, the present invention relates to means for cleaving a nucleic acid cleavage structure in a site-specific manner. While the present invention provides a variety of cleavage agents, in some embodiments, the present invention relates to a cleaving enzyme having 5' nuclease activity without interfering nucleic acid synthetic ability. In other embodiments, the present invention provides novel polymerases (e.g., thermostable polymerases) possessing altered polymerase and/or nucleases activities.

For example, in some embodiments, the present invention provides 5' nucleases derived from thermostable DNA polymerases that exhibit altered DNA synthetic activity from that of native thermostable DNA polymerases. The 5' nuclease activity of the polymerase is retained while the synthetic activity is reduced or absent. Such 5' nucleases are capable of catalyzing the structure-specific cleavage of nucleic acids in the absence of interfering synthetic activity. The lack of synthetic activity during a cleavage reaction results in nucleic acid cleavage products of uniform size.

The novel properties of the nucleases of the invention form the basis of a method of detecting specific nucleic acid sequences. This method relies upon the amplification of the detection molecule rather than upon the amplification of the target sequence itself as do existing methods of detecting specific target sequences.

DNA polymerases (DNAPs), such as those isolated from *E. coli* or from thermophilic bacteria of the genus *Thermus* as well as other organisms, are enzymes that synthesize new DNA strands. Several of the known DNAPs contain associated nuclease activities in addition to the synthetic activity of the enzyme.

Some DNAPs are known to remove nucleotides from the 5' and 3' ends of DNA chains (Kornberg, DNA Replication, W.H. Freeman and Co., San Francisco, pp. 127–139 [1980]). These nuclease activities are usually referred to as 5' exonuclease and 3' exonuclease activities, respectively. For example, the 5' exonuclease activity located in the N-terminal domain of several DNAPs participates in the removal of RNA primers during lagging strand synthesis during DNA replication and the removal of damaged nucleotides during repair. Some DNAPs, such as the *E. coli* DNA polymerase (DNAPEc1), also have a 3' exonuclease activity responsible for proof-reading during DNA synthesis (Kornberg, supra).

A DNAP isolated from *Thermus aquaticus*, termed Taq DNA polymerase (DNAPTaq), has a 5' exonuclease activity, but lacks a functional 3' exonucleolytic domain (Tindall and Kunkell, Biochem., 27:6008 [1988]). Derivatives of DNAPEc1 and DNAPTaq, respectively called the Klenow and Stoffel fragments, lack 5' exonuclease domains as a result of enzymatic or genetic manipulations (Brutlag et al., Biochem. Biophys. Res. Commun., 37:982 [1969]; Erlich et al., Science 252:1643 [1991]; Setlow and Kornberg, J. Biol. Chem., 247:232 [1972]).

The 5' exonuclease activity of DNAPTaq was reported to require concurrent synthesis (Gelfand, PCR Technology—Principles and Applications for DNA Amplification, H. A. Erlich, [Ed.], Stockton Press, New York, p. 19 [1989]). Although mononucleotides predominate among the digestion products of the 5' exonucleases of DNAPTaq and DNAPEc1, short oligonucleotides ($\leq 12$ nucleotides) can also be observed implying that these so-called 5' exonucleases can function endonucleolytically (Setlow, supra; Holland et al., Proc. Natl. Acad. Sci. USA 88:7276 [1991]).

In WO 92/06200, Gelfand et al. show that the preferred substrate of the 5' exonuclease activity of the thermostable DNA polymerases is displaced single-stranded DNA. Hydrolysis of the phosphodiester bond occurs between the displaced single-stranded DNA and the double-helical DNA with the preferred exonuclease cleavage site being a phosphodiester bond in the double helical region. Thus, the 5' exonuclease activity usually associated with DNAPs is a structure-dependent single-stranded endonuclease and is more properly referred to as a 5' nuclease. Exonucleases are enzymes that cleave nucleotide molecules from the ends of the nucleic acid molecule. Endonucleases, on the other hand, are enzymes that cleave the nucleic acid molecule at internal rather than terminal sites. The nuclease activity associated with some thermostable DNA polymerases cleaves endonucleolytically but this cleavage requires contact with the 5' end of the molecule being cleaved. Therefore, these nucleases are referred to as 5' nucleases.

When a 5' nuclease activity is associated with a eubacterial Type A DNA polymerase, it is found in the one third N-terminal region of the protein as an independent functional domain. The C-terminal two-thirds of the molecule constitute the polymerization domain that is responsible for the synthesis of DNA. Some Type A DNA polymerases also have a 3' exonuclease activity associated with the two-third C-terminal region of the molecule.

The 5' exonuclease activity and the polymerization activity of DNAPs can be separated by proteolytic cleavage or genetic manipulation of the polymerase molecule. The Klenow or large proteolytic cleavage fragment of DNAPEc1 contains the polymerase and 3' exonuclease activity but lacks the 5' nuclease activity. The Stoffel fragment of DNAPTaq (DNAPStf) lacks the 5' nuclease activity due to a genetic manipulation that deleted the N-terminal 289 amino acids of the polymerase molecule (Erlich et al., Science 252:1643 [1991]). WO 92/06200 describes a thermostable DNAP with an altered level of 5' to 3' exonuclease. U.S. Pat. No. 5,108,892 describes a *Thermus aquaticus* DNAP without a 5' to 3' exonuclease. Thermostable DNA polymerases with lessened amounts of synthetic activity are available (Third Wave Technologies, Madison, Wis.) and are described in U.S. Pat. Nos. 5,541,311, 5,614,402, 5,795,763, 5,691,142, and 5,837,450, herein incorporated by reference in their entireties. The present invention provides 5' nucleases derived from thermostable Type A DNA polymerases that retain 5' nuclease activity but have reduced or absent synthetic activity. The ability to uncouple the synthetic activity of the enzyme from the 5' nuclease activity proves that the 5' nuclease activity does not require concurrent DNA synthesis as was previously reported (Gelfand, PCR Technology, supra).

In addition to the 5'-exonuclease domains of the DNA polymerase I proteins of Eubacteria, described above, 5' nucleases have been found associated with bacteriophage, eukaryotes and archaebacteria. Overall, all of the enzymes in this family display very similar substrate specificities, despite their limited level of sequence similarity. Consequently, enzymes suitable for use in the methods of the present invention may be isolated or derived from a wide array of sources.

A mammalian enzyme with functional similarity to the 5'-exonuclease domain of *E. coli* Pol I was isolated nearly 30 years ago (Lindahl, et al., Proc Natl Acad Sci USA 62(2): 597–603 [1969]). Later, additional members of this group of enzymes called flap endonucleases (FEN1) from Eukarya and Archaea were shown to possess a nearly identical structure specific activity (Harrington and Lieber. Embo J 13(5), 1235–46 [1994]; Murante et al., J Biol Chem 269(2), 1191–6 [1994]; Robins, et al., J Biol Chem 269(46), 28535–8 [1994]; Hosfield, et al., J Biol Chem 273(42), 27154–61 [1998]), despite limited sequence similarity. The substrate specificities of the FEN1 enzymes, and the eubacterial and related bacteriophage enzymes have been examined and found to be similar for all enzymes (Lyamichev, et al., Science 260(5109), 778–83 [1993], Harrington and Lieber, supra, Murante, et al., supra, Hosfield, et al, supra, Rao, et al., J Bacteriol 180(20), 5406–12 [1998], Bhagwat, et al., J. Biol Chem 272(45), 28523–30 [1997], Garforth and Sayers, Nucleic Acids Res 25(19), 3801–7 [1997]).

Using preformed substrates, many of the studies cited above determined that these nucleases leave a gap upon cleavage, leading the authors to speculate that DNA polymerase must then act to fill in that gap to generate a ligatable nick. A number of other 5' nucleases have been shown to leave a gap or overlap after cleavage of the same or similar flap substrates. It has since been determined that that all the structure-specific 5'-exonucleases leave a nick after cleavage if the substrate has an overlap between the upstream and downstream duplexes (Kaiser et al., J. Biol. Chem. 274(30): 21387–21394 [1999]). While duplexes having several bases of overlapping sequence can assume several different conformations through branch migration, it was determined that cleavage occurs in the conformation where the last nucleotide at the 3' end of the upstream strand is unpaired, with the cleavage rate being essentially the same whether the end of the upstream primer is A, C, G, or T. It was determined to be positional overlap between the 3' end of the upstream primer and downstream duplex, rather then sequence overlap, that provides optimal cleavage. In addition to allowing these enzymes to leave a nick after cleavage, the single base of overlap causes the enzymes to cleave several orders of magnitude faster than when a substrate lacks overlap (Kaiser et al., supra).

Any of the 5' nucleases described below may find application in one or more embodiments of the methods described herein. 5' nucleases of particular utility in the methods of present invention include but are not limited to polymerases from a *Thermus* species including, but not limited to, *Thermus aquaticus, Thermus flavus, Thermus thermophilus, Thermus filiformus*, and *Thermus scotoductus*, and altered polymerases. Particularly preferred are altered polymerases exhibiting improved performance in detection assays based on the cleavage of a DNA member of an invasive cleavage structure that comprises an RNA target strand.

Chimerical polymerases may find application in one or more embodiments of the present invention, including but not limited to chimerical polymerases comprising one or more portions of one or more FEN nucleases including but are not limited to those of *Methanococcus jannaschii, Methanobacterium thermoautotrophicum, Archaeoglobus veneficus, Sulfolobus solfataricus, Pyrobaculum aerophilum, Thermococcus litoralis, Archaeaglobus profundus, Acidianus brierlyi, Acidianus ambivalens, Desulfurococcus amylolyticus, Desulfurococcus mobilis, Pyrodictium brockii, Thermococcus gorgonarius, Thermococcus zilligii, Methanopyrus kandleri, Methanococcus igneus, Pyrococcus horikoshii*, and *Aeropyrum pernix*; particularly preferred FEN1 enzymes are chimerical *Archaeoglobus fulgidus* and *Pyrococcus furiosus*. Particularly preferred are altered polymerases exhibiting improved performance in detection assays based on the cleavage of a DNA member of an invasive cleavage structure that comprises an RNA target strand.

The detailed description of the invention is presented in the following sections:
I. Detection of Specific Nucleic Acid Sequences Using 5' Nucleases in an INVADER Directed Cleavage Assay;
II. Signal Enhancement By Incorporating The Products Of An Invasive Cleavage Reaction Into A Subsequent Invasive Cleavage Reaction;
III. Effect of ARRESTOR Oligonucleotides on Signal and Background in Sequential Invasive Cleavage Reactions.
IV. Improved Enzymes For Use In INVADER Oligonucleotide-Directed Cleavage Reactions Comprising RNA Targets;
V. Reaction Design for INVADER Assay Detection of RNA Targets;
VI. Kits for performing the RNA INVADER Assay; and
VII. The INVADER Assay for Direct Detection and Measurement of Specific RNA Analytes.

I. Detection of Specific Nucleic Acid Sequences Using 5' Nucleases in an INVADER Directed Cleavage Assay 1. INVADER Assay Reaction Design The present invention provides means for forming a nucleic acid cleavage structure that is dependent upon the presence of a target nucleic acid and cleaving the nucleic acid cleavage structure so as to release distinctive cleavage products. 5' nuclease activity, for example, is used to cleave the target-dependent cleavage structure and the resulting cleavage products are indicative of the presence of specific target nucleic acid sequences in the sample. When two strands of nucleic acid, or oligonucleotides, both hybridize to a target nucleic acid strand such that they form an overlapping invasive cleavage structure, as described below, invasive cleavage can occur. Through the interaction of a cleavage agent (e.g., a 5' nuclease) and the upstream oligonucleotide, the cleavage agent can be made to cleave the downstream oligonucleotide at an internal site in such a way that a distinctive fragment is produced. Such embodiments have been termed the INVADER assay (Third Wave Technologies) and are described in U.S. Pat. Nos. 5,846,717, 5,985,557, 5,994,069, 6,001,567, 6,090,543, and 6,348,314, and PCT Publications WO 97/27214 and WO 98/42873, herein incorporated by reference in their entireties.

The present invention further provides assays in which the target nucleic acid is reused or recycled during multiple rounds of hybridization with oligonucleotide probes and cleavage of the probes without the need to use temperature cycling (i.e., for periodic denaturation of target nucleic acid strands) or nucleic acid synthesis (i.e., for the polymerization-based displacement of target or probe nucleic acid strands). When a cleavage reaction is run under conditions in which the probes are continuously replaced on the target strand (e.g. through probe-probe displacement or through an equilibrium between probe/target association and disassociation, or through a combination comprising these mechanisms, [Reynaldo et al., J. Mol. Biol. 97: 511 (2000)]) multiple probes can hybridize to the same target, allowing multiple cleavages, and the generation of multiple cleavage products.

By the extent of its complementarity to a target nucleic acid strand, an oligonucleotide may be said to define a specific region of the target. In an invasive cleavage structure, the two oligonucleotides define and hybridize to regions of the target that are adjacent to one another (i.e., regions without any additional region of the target between them). Either or both oligonucleotides may comprise additional portions that are not complementary to the target strand. In addition to hybridizing adjacently, in order to form an invasive cleavage structure, the 3' end of the upstream oligonucleotide must comprise an additional moiety. When both oligonucleotides are hybridized to a target strand to form a structure and such a 3' moiety is present on the upstream oligonucleotide within the structure, the oligonucleotides may be said to overlap, and the structure may be described as an overlapping, or invasive cleavage structure.

In one embodiment, the 3' moiety of the invasive cleavage structure is a single nucleotide. In this embodiment the 3' moiety may be any nucleotide (i.e., it may be, but it need not be complementary to the target strand). In a preferred embodiment the 3' moiety is a single nucleotide that is not complementary to the target strand. In another embodiment, the 3' moiety is a nucleotide-like compound (i.e., a moiety having chemical features similar to a nucleotide, such as a nucleotide analog or an organic ring compound; See e.g., U.S. Pat. No. 5,985,557). In yet another embodiment the 3' moiety is one or more nucleotides that duplicate in sequence one or more nucleotides present at the 5' end of the hybridized region of the downstream oligonucleotide. In a further embodiment, the duplicated sequence of nucleotides of the 3' moiety is followed by a single nucleotide that is not further duplicative of the downstream oligonucleotide sequence, and that may be any other nucleotide. In yet another embodiment, the duplicated sequence of nucleotides of the 3' moiety is followed by a nucleotide-like compound, as described above.

The downstream oligonucleotide may have, but need not have, additional moieties attached to either end of the region that hybridizes to the target nucleic acid strand. In a preferred embodiment, the downstream oligonucleotide comprises a moiety at its 5' end (i.e., a 5' moiety). In a particularly preferred embodiment, said 5' moiety is a 5' flap or arm comprising a sequence of nucleotides that is not complementary to the target nucleic acid strand.

When an overlapping cleavage structure is formed, it can be recognized and cleaved by a nuclease that is specific for this structure (i.e., a nuclease that will cleave one or more of the nucleic acids in the overlapping structure based on recognition of this structure, rather than on recognition of a nucleotide sequence of any of the nucleic acids forming the structure). Such a nuclease may be termed a "structure-specific nuclease". In some embodiments, the structure-specific nuclease is a 5' nuclease. In a preferred embodiment, the structure-specific nuclease is the 5' nuclease of a DNA polymerase. In another preferred embodiment, the DNA polymerase having the 5' nuclease is synthesis-deficient. In another preferred embodiment, the 5' nuclease is a FEN-1 endonuclease. In a particularly preferred embodiment, the 5' nuclease is thermostable.

In some embodiments, said structure-specific nuclease preferentially cleaves the downstream oligonucleotide. In a preferred embodiment, the downstream oligonucleotide is cleaved one nucleotide into the 5' end of the region that is hybridized to the target within the overlapping structure. Cleavage of the overlapping structure at any location by a structure-specific nuclease produces one or more released portions or fragments of nucleic acid, termed "cleavage products."

In some embodiments, cleavage of an overlapping structure is performed under conditions wherein one or more of the nucleic acids in the structure can disassociate (i.e. un-hybridize, or melt) from the structure. In one embodiment, full or partial disassociation of a first cleavage structure allows the target nucleic acid to participate in the formation of one or more additional overlapping cleavage structures. In a preferred embodiment, the first cleavage structure is partially disassociated. In a particularly preferred embodiment only the oligonucleotide that is cleaved disassociates from the first cleavage structure, such that it may be replaced by another copy of the same oligonucleotide. In some embodiments, said disassociation is induced by an increase in temperature, such that one or more oligonucleotides can no longer hybridize to the target strand. In other embodiments, said disassociation occurs because cleavage of an oligonucleotide produces only cleavage products that cannot bind to the target strand under the conditions of the reaction. In a preferred embodiment, conditions are selected wherein an oligonucleotide may associate with (i.e., hybridize to) and disassociate from a target strand regardless of cleavage, and wherein the oligonucleotide may be cleaved when it is hybridized to the target as part of an overlapping cleavage structure. In a particularly preferred embodiment, conditions are selected such that the number of copies of the oligonucleotide that can be cleaved when part of an overlapping structure exceeds the number of copies of the target nucleic acid strand by a sufficient amount that when the first cleavage structure disassociates, the probability that the target strand will associate with an intact copy of the oligonucleotide is greater than the probability that that it will associate with a cleaved copy of the oligonucleotide.

In some embodiments, cleavage is performed by a structure-specific nuclease that can recognize and cleave structures that do not have an overlap. In a preferred embodiment, cleavage is performed by a structure-specific nuclease having a lower rate of cleavage of nucleic acid structures that do not comprise an overlap, compared to the rate of cleavage of structures comprising an overlap. In a particularly preferred embodiment, cleavage is performed by a structure-specific nuclease having less than 1% of the rate of cleavage of nucleic acid structures that do not comprise an overlap, compared to the rate of cleavage of structures comprising an overlap.

In some embodiments it is desirable to detect the cleavage of the overlapping cleavage structure. Detection may be by analysis of cleavage products or by analysis of one or more of the remaining uncleaved nucleic acids. For convenience, the following discussion will refer to the analysis of cleavage products, but it will be appreciated by those skilled in the art that these methods may as easily be applied to analysis of the uncleaved nucleic acids in an invasive cleavage reaction. Any method known in the art for analysis of nucleic acids, nucleic acid fragments or oligonucleotides may be applied to the detection of cleavage products.

In one embodiment, the cleavage products may be identified by chemical content, e.g., the relative amounts of each atom, each particular type of reactive group or each nucleotide base (Chargaff et al., *J. Biol. Chem.* 177: 405 [1949]) they contain. In this way, a cleavage product may be distinguished from a longer nucleic acid from which it was released by cleavage, or from other nucleic acids.

In another embodiment, the cleavage products may be distinguished by a particular physical attribute, including but not limited to length, mass, charge, or charge-to-mass ratio. In yet another embodiment, the cleavage product may be distinguished by a behavior that is related to a physical attribute, including but not limited to rate of rotation in solution, rate of migration during electrophoresis, coefficient of sedimentation in centrifugation, time of flight in MALDI-TOF mass spectrometry, migration rate or other behavior in chromatography, melting temperature from a complementary nucleic acid, or precipitability from solution.

Detection of the cleavage products may be through release of a label. Such labels may include, but are not limited to one or more of any of dyes, radiolabels such as $^{32}P$ or $^{35}S$, binding moieties such as biotin, mass tags, such as metal ions or chemical groups, charge tags, such as polyamines or charged dyes, haptens such as digoxgenin, luminogenic, phosphorescent or fluorogenic moieties, and fluorescent dyes, either alone or in combination with moieties that can suppress or shift emission spectra, such as by fluorescence resonance energy transfer (FRET) or collisional fluorescence energy transfer.

In some embodiments, analysis of cleavage products may include physical resolution or separation, for example by electrophoresis, hybridization or by selective binding to a support, or by mass spectrometry methods such as MALDI-TOF. In other embodiments, the analysis may be performed without any physical resolution or separation, such as by detection of cleavage-induced changes in fluorescence as in FRET-based analysis, or by cleavage-induced changes in the rotation rate of a nucleic acid in solution as in fluorescence polarization analysis.

Cleavage products can be used subsequently in any reaction or read-out method that can make use of oligonucleotides. Such reactions include, but are not limited to, modification reactions, such as ligation, tailing with a template-independent nucleic acid polymerase and primer extension with a template-dependent nucleic acid polymerase. The modification of the cleavage products may be for purposes including, but not limited to, addition of one or more labels or binding moieties, alteration of mass, addition of specific sequences, or for any other purpose that would facilitate analysis of either the cleavage products or analysis of any other by-product, result or consequence of the cleavage reaction.

Analysis of the cleavage products may involve subsequent steps or reactions that do not modify the cleavage products themselves. For example, cleavage products may be used to complete a functional structure, such as a competent promoter for in vitro transcription or another protein binding site. Analysis may include the step of using the completed structure for or to perform its function. One or more cleavage products may also be used to complete an overlapping cleavage structure, thereby enabling a subsequent cleavage reaction, the products of which may be detected or used by any of the methods described herein, including the participation in further cleavage reactions.

Certain preferred embodiments of the invasive cleavage reactions are provided in the following descriptions. In some embodiments, the methods of the present invention employ at least a pair of oligonucleotides that interact with a target nucleic acid to form a cleavage structure for a structure-specific nuclease. In some embodiments, the cleavage structure comprises i) a target nucleic acid that may be either single-stranded or double-stranded (when a double-stranded target nucleic acid is employed, it may be rendered single stranded, e.g., by heating); ii) a first oligonucleotide, termed the "probe," that defines a first region of the target nucleic acid sequence by being the complement of that region; iii) a second oligonucleotide, termed the "INVADER oligonucleotide," the 5' part of which defines a second region of the same target nucleic acid sequence, adjacent to and downstream of the first target region, and the second part of which overlaps into the region defined by the first oligonucleotide.

It can be considered that the binding of these oligonucleotides in this embodiment divides the target nucleic acid into three distinct regions: one region that has complementarity to only the probe; one region that has complementarity only to the INVADER oligonucleotide; and one region that has complementarity to both oligonucleotides. As discussed above, in some preferred embodiments of the present invention, the overlap may comprise moieties other than overlapping complementary bases. Thus, in some embodiments, there is a physical, but not sequence, overlap between the INVADER and probe oligonucleotides, i.e., in these latter embodiments, there is not a region of the target nucleic acid that has complementarity to both oligonucleotides.

a) Oligonucleotide Design

Design of these oligonucleotides (i.e., the INVADER oligonucleotide and the probe) is accomplished using practices that are standard in the art. For example, sequences that have self-complementarity, such that the resulting oligonucleotides would either fold upon themselves, or hybridize to each other at the expense of binding to the target nucleic acid, are generally avoided.

One consideration in choosing a length for these oligonucleotides is the complexity of the sample containing the target nucleic acid. For example, the human genome is approximately $3 \times 10^9$ basepairs in length. Any 10-nucleotide sequence will appear with a frequency of $1:4^{10}$, or 1:1,048,576 in a random string of nucleotides, which would be approximately 2,861 times in 3 billion basepairs. Clearly, an oligonucleotide of this length would have a poor chance of binding uniquely to a 10-nucleotide region within a target having a sequence the size of the human genome. If the target sequence were within a 3 kb plasmid, however, such an oligonucleotide might have a very reasonable chance of binding uniquely. By this same calculation it can be seen that an oligonucleotide of 16 nucleotides (i.e., a 16-mer) is the minimum length of a sequence that is mathematically likely to appear once in $3 \times 10^9$ basepairs. This level of specificity may also be provided by two or more shorter oligonucleotides if they are configured to bind in a cooperative fashion (i.e., such that they can produce the intended complex only if both or all are bound to their intended target sequences), wherein the combination of the short oligonucleotides provides the desired specificity. In one such embodiment, the cooperativity between the shorter oligonucleotides is by a coaxial stacking effect that can occur when the oligonucleotides hybridize to adjacent sites on a target nucleic acid. In another embodiment, the shorter oligonucleotides are connected to one another, either directly, or by one or more spacer regions. The short oligonucleotides thus connected may bind to distal regions of the target and may be used to bridge across regions of secondary structure in a target. Examples of such bridging oligonucleotides are described in PCT Publication WO 98/50403, herein incorporated by reference in its entirety.

A second consideration in choosing oligonucleotide length is the temperature range in which the oligonucleotides will be expected to function. A 16-mer of average base content (50% G-C bases) will have a calculated $T_m$ of about 41° C., depending on, among other things, the concentration of the oligonucleotide and its target, the salt content of the reaction and the precise order of the nucleotides. As a practical matter, longer oligonucleotides are usually chosen to enhance the specificity of hybridization. Oligonucleotides 20 to 25 nucleotides in length are often used, as they are highly likely to be specific if used in reactions conducted at temperatures that are near their $T_m$s (within about 5° C. of the $T_m$). In addition, with calculated $T_m$s in the range of 50 to 70° C., such oligonucleotides (i.e., 20 to 25-mers) are appropriately used in reactions catalyzed by thermostable enzymes, which often display optimal activity near this temperature range.

The maximum length of the oligonucleotide chosen is also based on the desired specificity. One should avoid choosing sequences that are so long that they are either at a high risk of binding stably to partial complements, or that they cannot easily be dislodged when desired (e.g., failure to disassociate from the target once cleavage has occurred or failure to disassociate at a reaction temperature suitable for the enzymes and other materials in the reaction).

The first step of design and selection of the oligonucleotides for the INVADER oligonucleotide-directed cleavage is in accordance with these sample general principles. Considered as sequence-specific probes individually, each oligonucleotide may be selected according to the guidelines listed above. That is to say, each oligonucleotide will generally be long enough to be reasonably expected to hybridize only to the intended target sequence within a complex sample, usually in the 20 to 40 nucleotide range. Alternatively, because the INVADER oligonucleotide-directed cleavage assay depends upon the concerted action of these oligonucleotides, the composite length of the 2 oligonucleotides which span/bind to the target may be selected to fall within this range, with each of the individual oligonucleotides being in approximately the 13 to 17 nucleotide range. Such a design might be employed if a non-thermostable cleavage means were employed in the reaction, requiring the reactions to be conducted at a lower temperature than that used when thermostable cleavage means are employed. In some embodiments, it may be desirable to have these oligonucleotides bind multiple times within a single target nucleic acid (e.g., to bind to multiple variants or multiple similar sequences within a target). It is not intended that the method of the present invention be limited to any particular size of the probe or INVADER oligonucleotide.

The second step of designing an oligonucleotide pair for this assay is to choose the degree to which the upstream "INVADER" oligonucleotide sequence will overlap into the downstream "probe" oligonucleotide sequence, and consequently, the sizes into which the probe will be cleaved. In some preferred embodiments, the probe oligonucleotide can be made to "turn over," that is to say probe can be made to depart to allow the binding and cleavage of other copies of the probe molecule, without the requirements of thermal denaturation or displacement by polymerization. While in one embodiment of this assay probe turnover may be facilitated by an exonucleolytic digestion by the cleavage agent, in some preferred embodiments of the present invention turnover does not require this exonucleolytic activity. For example, in some embodiments, a reaction temperature and reaction conditions are selected so as to create an equilibrium wherein the probe hybridizes and disassociates from the target. In other embodiments, temperature and reaction conditions are selected so that unbound probe can initiate binding to the target strand and physically displace bound probe. In still other embodiments, temperature and reaction conditions are selected such that either or both mechanisms of probe replacement may occur in any proportion. The method of the present invention is not limited to any particular mechanism of probe replacement. By any mechanism, when the probe is bound to the target to form a cleavage structure, cleavage can occur. The continuous cycling of the probe on and off of the target allows multiple probes to bind and be cleaved for each copy of a target nucleic acid.

i) Non-Sequence Overlaps

It has been determined that the relationship between the 3' end of the upstream oligonucleotide and the desired site of cleavage on the probe should be carefully designed. It is known that the preferred site of cleavage for the types of structure-specific endonucleases employed herein is one basepair into a duplex (Lyamichev et al., supra). It was previously believed that the presence of an upstream oligonucleotide or primer allowed the cleavage site to be shifted away from this preferred site, into the single stranded region of the 5' arm (Lyamichev et al., supra and U.S. Pat. No. 5,422,253). In contrast to this previously proposed mechanism, and while not limiting the present invention to any particular mechanism, it is believed that the nucleotide immediately 5', or upstream of the cleavage site on the probe (including miniprobe and mid-range probes) should be able to basepair with the target for efficient cleavage to occur. In the case of the present invention, this would be the nucleotide in the probe sequence immediately upstream of the intended cleavage site. In addition, as described herein, it has been observed that in order to direct cleavage to that same site in the probe, the upstream oligonucleotide should have its 3' base (i.e., nt) immediately upstream of the intended cleavage site of the probe. In embodiments where the INVADER and probe oligonucleotides share a sequence overlap, this places the 3' terminal nucleotide of the upstream oligonucleotide and the base of the probe oligonucleotide 5' of the cleavage site in competition for pairing with the corresponding nucleotide of the target strand.

To examine the outcome of this competition (i.e. which base is paired during a successful cleavage event), substitutions were made in the probe and INVADER oligonucleotides such that either the probe or the INVADER oligonucleotide were mismatched with the target sequence at this position. The effects of both arrangements on the rates of cleavage were examined. When the INVADER oligonucleotide is unpaired at the 3' end, the rate of cleavage was not reduced. If this base was removed, however, the cleavage site was shifted upstream of the intended site. In contrast, if the probe oligonucleotide was not base-paired to the target just upstream of the site to which the INVADER oligonucleotide was directing cleavage, the rate of cleavage was dramatically reduced, suggesting that when a competition exists, the probe oligonucleotide was the molecule to be base-paired in this position.

It appears that the 3' end of the upstream INVADER oligonucleotide is unpaired during cleavage, and yet is important for accurate positioning of the cleavage. To examine which part(s) of the 3' terminal nucleotide are required for the positioning of cleavage, INVADER oligonucleotides were designed that terminated on this end with nucleotides that were altered in a variety of ways. Sugars examined included 2' deoxyribose with a 3' phosphate group, a dideoxyribose, 3' deoxyribose, 2' O-methyl ribose, arabinose and arabinose with a 3' phosphate. Abasic ribose, with and without 3' phosphate were tested. Synthetic "universal" bases such at 3-nitropyrrole and 5–3 nitroindole on ribose sugars were tested. Finally, a base-like aromatic ring structure, acridine, linked to the 3' end the previous nucleotide without a sugar group was tested. The results obtained support the conclusion that the aromatic ring of the base (at the 3' end of the INVADER oligonuceotide) is an important moiety for accomplishing the direction of cleavage to the desired site within the downstream probe. The 3' terminal moiety of the INVADER oligonucleotide need not be a base that is complementary to the target nucleic acid.

ii) Miniprobes and Mid-Range Probes;

As discussed above, the INVADER oligonucleotide-directed cleavage assay may be performed using INVADER and probe oligonucleotides that have a length of about 13–25 nucleotides (typically 20–25 nucleotides). It is also contemplated that the oligonucleotides may themselves be composed of shorter oligonucleotide sequences that align along a target strand but that are not covalently linked. This is to say that there is a nick in the sugar-phosphate backbone of the composite oligonucleotide, but that there is no disruption in the progression of base-paired nucleotides in the resulting duplex. When short strands of nucleic acid align contiguously along a longer strand the hybridization of each is stabilized by the hybridization of the neighboring fragments because the basepairs can stack along the helix as though the backbone was in fact uninterrupted. This cooperativity of binding can give each segment a stability of interaction in excess of what would be expected for the segment hybridizing to the longer nucleic acid alone. One application of this observation has been to assemble primers for DNA sequencing, typically about 18 nucleotides long, from sets of three hexamer oligonucleotides that are designed to hybridize in this way (Kotler et al. Proc. Natl. Acad. Sci. USA 90:4241 [1993]). The resulting doubly-nicked primer can be extended enzymatically in reactions performed at temperatures that might be expected to disrupt the hybridization of hexamers, but not of 18-mers.

The use of composite or split oligonucleotides is applied with success in the INVADER-directed cleavage assay. For example, the probe oligonucleotide may be split into two oligonucleotides that anneal in a contiguous and adjacent manner along a target oligonucleotide such that the downstream oligonucleotide (analogous to the probe) is assembled from two smaller pieces: a short segment of 6–10 nts (termed the "miniprobe"), that is to be cleaved in the course of the detection reaction, and an oligonucleotide that hybridizes immediately downstream of the miniprobe (termed the "stacker"), that serves to stabilize the hybridization of the probe. To form the cleavage structure, an upstream oligonucleotide (the INVADER oligonucleotide) is provided to direct the cleavage activity to the desired region of the miniprobe. Assembly of the probe from non-linked pieces of nucleic acid (i.e., the miniprobe and the stacker) allows regions of sequences to be changed without requiring the re-synthesis of the entire proven sequence, thus improving the cost and flexibility of the detection system. In addition, the use of unlinked composite oligonucleotides makes the system more stringent in its requirement of perfectly matched hybridization to achieve signal generation, allowing this to be used as a sensitive means of detecting mutations or changes in the target nucleic acid sequences.

In one embodiment, the methods of the present invention employ at least three oligonucleotides that interact with a target nucleic acid to form a cleavage structure for a structure-specific nuclease. More specifically, the cleavage structure comprises i) a target nucleic acid that may be either single-stranded or double-stranded (when a double-stranded target nucleic acid is employed, it may be rendered single-stranded, e.g., by heating); ii) a first oligonucleotide, termed the "stacker," that defines a first region of the target nucleic acid sequence by being the complement of that region; iii) a second oligonucleotide, termed the "miniprobe," that defines a second region of the target nucleic acid sequence by being the complement of that region; iv) a third oligonucleotide, termed the "INVADER oligonucleotide," the 5' part of which defines a third region of the same target nucleic acid sequence, adjacent to and downstream of the second target region, and the second or 3' part of which overlaps into the region defined by the second oligonucleotide As described above for embodiments that do not employ a stacker, the overlap region can represent a region where there is a physical, but not sequence, overlap between the INVADER and probe oligonucleotides.

In addition to the benefits cited above, the use of a composite design for the oligonucleotides that form the cleavage structure allows more latitude in the design of the reaction conditions for performing the INVADER-directed cleavage assay. When a longer probe (e.g., 16–25 nt), as described above, is used for detection in reactions that are performed at temperatures below the $T_m$ of that probe, the cleavage of the probe may play a significant role in destabilizing the duplex of which it is a part, thus allowing turnover and reuse of the recognition site on the target nucleic acid. In contrast, reaction temperatures that are at or above the $T_m$ of the probe mean that the probe molecules are hybridizing and releasing from the target quite rapidly even without cleavage of the probe. When an upstream INVADER oligonucleotide and a cleavage agent are provided the probe will be specifically cleaved, but the cleavage will not be necessary to the turnover of the probe. When a long probe (e.g., 16–25 nt) is used in this way the temperatures required to achieve this state is high, around 65 to 70° C. for a 25-mer of average base composition. Requiring the use of such elevated temperatures limits the choice of cleavage agents to those that are very thermostable, and may contribute to background in the reactions, depending of the means of detection, through thermal degradation of the probe oligonucleotides. With miniprobes, this latter mechanism of probe replacement may be accomplished at a lower temperature. Thus, shorter probes are preferred for embodiments using lower reaction temperatures.

The miniprobe of the present invention may vary in size depending on the desired application. In one embodiment, the probe may be relatively short compared to a standard probe (e.g., 16–25 nt), in the range of 6 to 10 nucleotides. When such a short probe is used, reaction conditions can be chosen that prevent hybridization of the miniprobe in the absence of the stacker oligonucleotide. In this way a short probe can be made to assume the statistical specificity and selectivity of a longer sequence. In the event of a perturbation in the cooperative binding of the miniprobe and stacker nucleic acids, as might be caused by a mismatch within the short sequence that is otherwise complementary to the target nucleic acid or at the junction between the contiguous duplexes, this cooperativity can be lost, dramatically reducing the stability of the shorter duplex (i.e., that of the miniprobe), and thus reducing the level of cleaved product in the assay of the present invention.

It is also contemplated that probes of intermediate size may be used. Such probes, in the 11 to 15 nucleotide range, may blend some of the features associated with the longer probes as originally described, these features including the ability to hybridize and be cleaved absent the help of a stacker oligonucleotide. At temperatures below the expected $T_m$ of such probes, the mechanisms of turnover may be as discussed above for probes in the 20 nt range, and be dependent on the removal of the sequence in the overlap region for destabilization and cycling.

The mid-range probes may also be used at elevated temperatures, at or above their expected $T_m$, to allow melting rather than cleavage to promote probe turnover. In contrast to the longer probes described above, however, the temperatures required to allow the use of such a thermally driven turnover are much lower (about 40 to 60° C.), thus preserving both the cleavage means and the nucleic acids in the reaction from thermal degradation. In this way, the mid-range probes may perform in some instances like the miniprobes described above. In a further similarity to the miniprobes, the accumulation of cleavage signal from a midrange probe may be helped under some reaction conditions by the presence of a stacker.

To summarize, a standard long probe usually does not benefit from the presence of a stacker oligonucleotide downstream (the exception being cases where such an oligonucleotide may also disrupt structures in the target nucleic acid that interfere with the probe binding), and it may be used in conditions requiring several nucleotides to be removed to allow the oligonucleotide to release from the target efficiently. If temperature of the reaction is used to drive exchange of the probes, standard probes may require use of a temperature at which nucleic acids and enzymes are at higher risk of thermal degradation.

The miniprobe is very short and performs optimally in the presence of a downstream stacker oligonucleotide. The miniprobes are well suited to reactions conditions that use the temperature of the reaction to drive rapid exchange of the probes on the target regardless of whether any bases have been cleaved. In reactions with sufficient amount of the cleavage means, the probes that do bind will be rapidly cleaved before they melt off.

The mid-range or midiprobe combines features of these probes and can be used in reactions like those favored by long probes, with longer regions of overlapto drive probe turnover at lower temperature. In a preferred embodiment, the midrange probes are used at temperatures sufficiently high that the probes are hybridizing to the target and releasing rapidly regardless of cleavage. The mid-range probe may have enhanced performance in the presence of a stacker under some circumstances.

The distinctions between the mini-, midi-(i.e., mid-range) and long probes are not contemplated to be inflexible and based only on length. The performance of any given probe may vary with its specific sequence, the choice of solution conditions, the choice of temperature and the selected cleavage means.

The assemblage of oligonucleotides that comprises the cleavage structure of the present invention is sensitive to mismatches between the probe and the target. It is also contemplated that a mismatch between the INVADER oligonucleotide and the target may be used to distinguish related target sequences. In the 3-oligonucleotide system, comprising an INVADER, a probe and a stacker oligonucleotide, it is contemplated that mismatches may be located within any of the regions of duplex formed between these oligonucleotides and the target sequence. In a preferred embodiment, a mismatch to be detected is located in the probe. In a particularly preferred embodiment, the mismatch is in the probe, at the basepair immediately upstream (i.e., 5') of the site that is cleaved when the probe is not mismatched to the target.

In another preferred embodiment, a mismatch to be detected is located within the region defined by the hybridization of a miniprobe. In a particularly preferred embodiment, the mismatch is in the miniprobe, at the basepair immediately upstream (i.e., 5') of the site that is cleaved when the miniprobe is not mismatched to the target.

iii) Software for Oligonucleotide Design for the INVADER Assay

The present invention provides systems and methods for the design of oligonucleotides for use in detection assays. In particular, the present invention provides systems and methods for the design of oligonucleotides that successfully hybridize to appropriate regions of target nucleic acids (e.g., regions of target nucleic acids that do not contain secondary structure) under the desired reaction conditions (e.g., temperature, buffer conditions, etc.) for the detection assay. The systems and methods also allow for the design of multiple different oligonucleotides (e.g., oligonucleotides that hybridize to different portions of a target nucleic acid or that hybridize to two or more different target nucleic acids) that all function in the detection assay under the same or substantially the same reaction conditions. These systems and methods may also be used to design control samples that work under the experimental reaction conditions.

While the systems and methods of the present invention are not limited to any particular detection assay, the following description illustrates the invention when used in conjunction with the INVADER assay (Third Wave Technologies, Madison Wis.; See e.g., U.S. Pat. Nos. 5,846,717, 5,985,557, 5,994,069, and 6,001,567 and PCT Publications WO 97/27214 and WO 98/42873, incorporated herein by reference in their entireties) to detect a SNP. One skilled in the art will appreciate that specific and general features of this illustrative example are generally applicable to other detection assays, and for use in designing INVADER assays for purposes other than SNP detection (e.g., for DNA or RNA quantitation, for RNA splice junction detection, etc.). Further, it will be appreciated that all algorithms described herein can be applied as separate software elements, or calculations may be performed manually, for the design of any INVADER assay probe set without use of the INVADERCREATOR design system described below.

Oligonucleotide Design for the INVADER Assay Using the INVADERCREATOR Program

In some embodiments where an oligonucleotide is designed for use in the INVADER assay to detect a SNP, the sequence(s) of interest are entered into the INVADERCREATOR program (Third Wave Technologies, Madison, Wis.). As described above, sequences may be input for analysis from any number of sources, either directly into the computer hosting the INVADERCREATOR program, or via a remote computer linked through a communication network (e.g., a LAN, Intranet or Internet network). The program designs probes for both the sense and antisense strand. Strand selection is generally based upon the ease of synthesis, minimization of secondary structure formation, and manufacturability. In some embodiments, the user chooses the strand for sequences to be designed for. In other embodiments, the software automatically selects the strand. By incorporating thermodynamic parameters for optimum probe cycling and signal generation (Allawi and SantaLucia, Biochemistry, 36:10581 [1997]), oligonucleotide probes may be designed to operate at a pre-selected assay temperature (e.g., 63° C.). Based on these criteria, a final probe set (e.g., primary probes for 2 alleles and an INVADER oligonucleotide) is selected.

In some embodiments, the INVADERCREATOR system is a web-based program with secure site access that contains a link to BLAST (available at the National Center for Biotechnology Information, National Library of Medicine, National Institutes of Health web site) and that can be linked to RNAstructure (Mathews et al., RNA 5:1458 [1999]), a software program that incorporates mfold (Zuker, Science, 244:48 [1989]). RNAstructure tests the proposed oligonucleotide designs generated by INVADERCREATOR for potential uni- and bimolecular complex formation. INVADERCREATOR is open database connectivity (ODBC)-compliant and uses the Oracle database for export/integration. The INVADERCREATOR system was configured with Oracle to work well with UNIX systems, as most genome centers are UNIX-based.

In some embodiments, the INVADERCREATOR analysis is provided on a separate server (e.g., a Sun server) so it can handle analysis of large batch jobs. For example, a customer can submit up to 2,000 SNP sequences in one email. The server passes the batch of sequences on to the INVADER-CREATOR software, and, when initiated, the program designs SNP sets. In some embodiments, probe set designs are returned to the user within 24 hours of receipt of the sequences.

In some preferred embodiments, each INVADER assay reaction includes at least two target sequence-specific, unlabeled oligonucleotides for the primary reaction: an upstream INVADER oligonucleotide and a downstream Probe oligonucleotide. The INVADER oligonucleotide is generally designed to bind stably at the reaction temperature, while the probe is designed to freely associate and disassociate with the target strand, with cleavage occurring only when an uncut probe hybridizes adjacent to an overlapping INVADER oligonucleotide. In some embodiments, the probe includes a 5' flap or "arm" that is not complementary to the target, and this flap is released from the probe when cleavage occurs. In some embodiments, the released flap participates as an INVADER oligonucleotide in a secondary reaction.

The following discussion provides one example of how a user interface for an INVADERCREATOR program may be configured.

Figure 42:
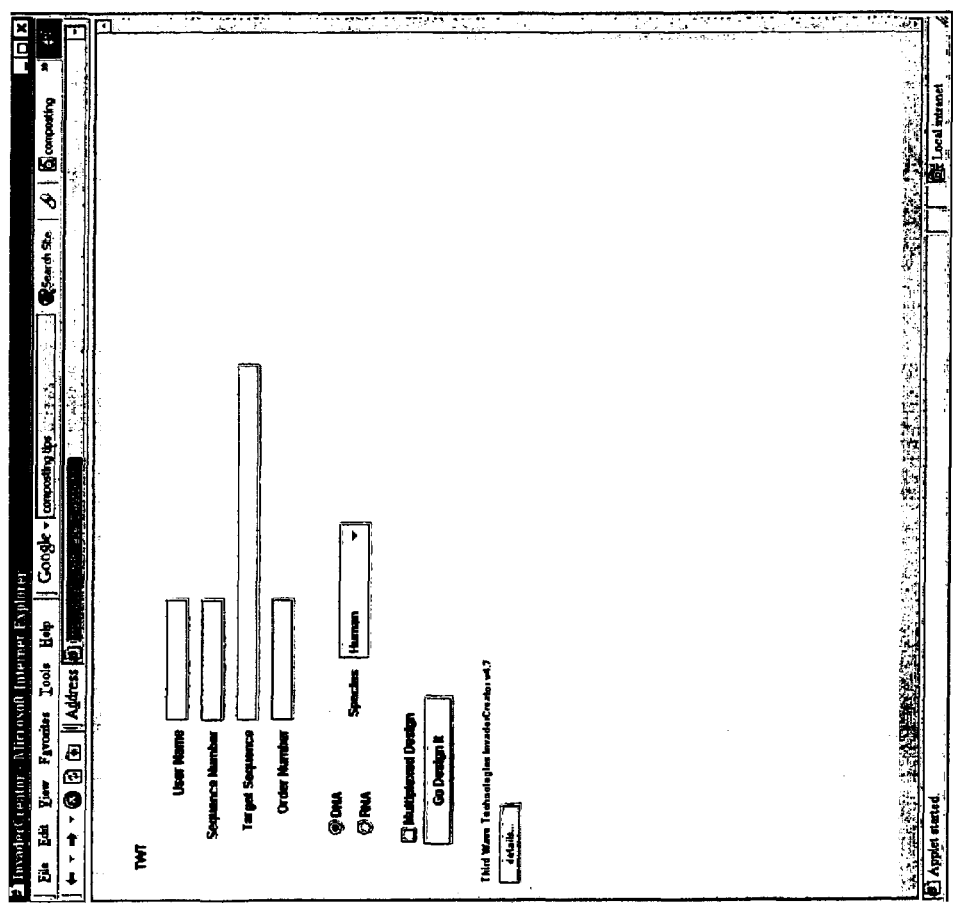
FIG. 42 shows a computer display of an INVADERCREATOR Order Entry screen.

The user opens a work screen (FIG. 42), e.g., by clicking on an icon on a desktop display of a computer (e.g., a Windows desktop). The user enters information related to the target sequence for which an assay is to be designed. In some embodiments, the user enters a target sequence. In other embodiments, the user enters a code or number that causes retrieval of a sequence from a database. In still other embodiments, additional information may be provided, such as the user's name, an identifying number associated with a target sequence, and/or an order number. In preferred embodiments, the user indicates (e.g. via a check box or drop down menu) that the target nucleic acid is DNA or RNA. In other preferred embodiments, the user indicates the species from which the nucleic acid is derived. In particularly preferred embodiments, the user indicates whether the design is for monoplex (i.e., one target sequence or allele per reaction) or multiplex (i.e., multiple target sequences or alleles per reaction) detection. When the requisite choices and entries are complete, the user starts the analysis process. In one embodiment, the user clicks a "Go Design It" button to continue.

In some embodiments, the software validates the field entries before proceeding. In some embodiments, the software verifies that any required fields are completed with the appropriate type of information. In other embodiments, the software verifies that the input sequence meets selected requirements (e.g., minimum or maximum length, DNA or RNA content). If entries in any field are not found to be valid, an error message or dialog box may appear. In preferred embodiments, the error message indicates which field is incomplete and/or incorrect. Once a sequence entry is verified, the software proceeds with the assay design.

In some embodiments, the information supplied in the order entry fields specifies what type of design will be created. In preferred embodiments, the target sequence and multiplex check box specify which type of design to create. Design options include but are not limited to SNP assay, Multiplexed SNP assay (e.g., wherein probe sets for different alleles are to be combined in a single reaction), Multiple SNP assay (e.g., wherein an input sequence has multiple sites of variation for which probe sets are to be designed), and Multiple Probe Arm assays.

In some embodiments, the INVADERCREATOR software is started via a Web Order Entry (WebOE) process (i.e., through an Intra/Internet browser interface) and these parameters are transferred from the WebOE via applet <param> tags, rather than entered through menus or check boxes.

Figure 43:
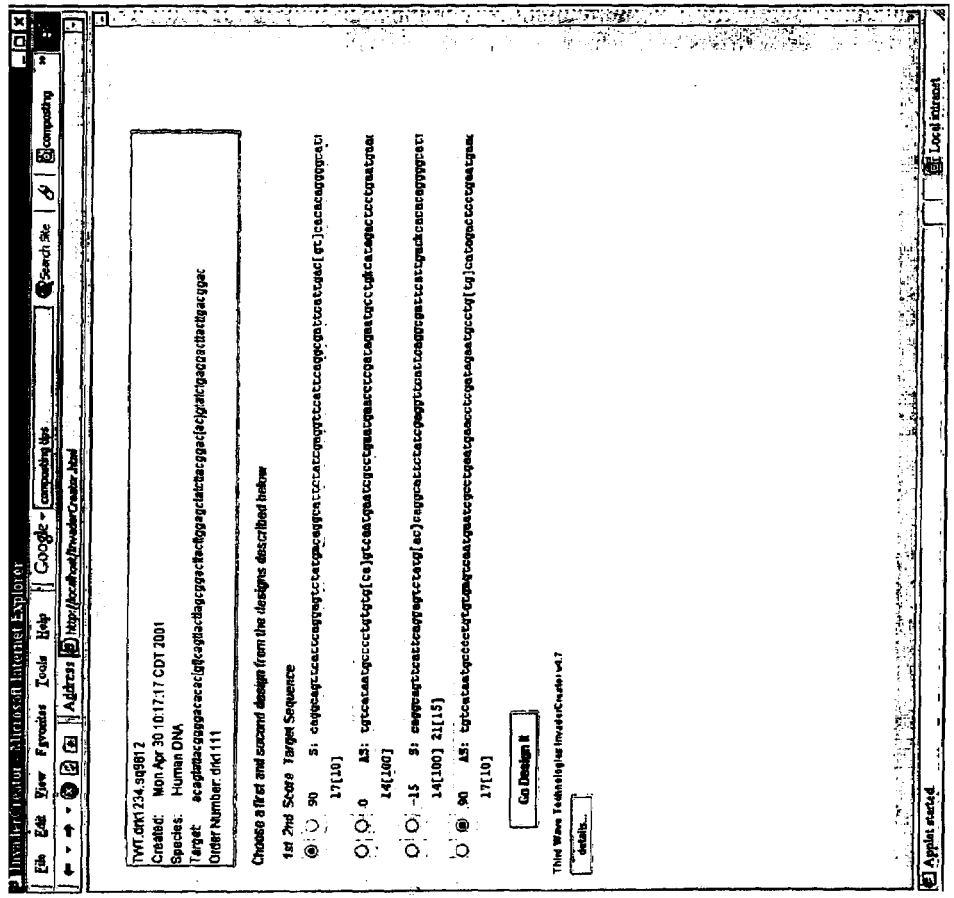
FIG. 43 shows a computer display of an INVADERCREATOR Multiple SNP Design Selection screen.

In the case of Multiple SNP Designs, the user chooses two or more designs to work with. In some embodiments, this selection opens a new screen view (e.g., a Multiple SNP Design Selection view FIG. 43). In some embodiments, the software creates designs for each locus in the target sequence, scoring each, and presents them to the user in this screen view. The user can then choose any two designs to work with. In some embodiments, the user chooses a first and second design (e.g., via a menu or buttons) and clicks a "Go Design It" button to continue.

To select a probe sequence that will perform optimally at a pre-selected reaction temperature, the melting temperature ($T_m$) of the SNP to be detected is calculated using the nearest-neighbor model and published parameters for DNA duplex formation (Allawi and SantaLucia, Biochemistry, 36:10581 [1997]). In embodiments wherein the target strand is RNA, parameters appropriate for RNA/DNA heteroduplex formation may be used. Because the assay's salt concentrations are often different than the solution conditions in which the nearest-neighbor parameters were obtained (1M NaCl and no divalent metals), and because the presence and concentration of the enzyme influence optimal reaction temperature, an adjustment should be made to the calculated $T_m$ to determine the optimal temperature at which to perform a reaction. One way of compensating for these factors is to vary the value provided for the salt concentration within the melting temperature calculations. This adjustment is termed a 'salt correction'. As used herein, the term "salt correction" refers to a variation made in the value provided for a salt concentration for the purpose of reflecting the effect on a $T_m$ calculation for a nucleic acid duplex of a non-salt parameter or condition affecting said duplex. Variation of the values provided for the strand concentrations will also affect the outcome of these calculations. By using a value of 0.5 M NaCl (SantaLucia, Proc Natl Acad Sci USA, 95:1460 [1998]) and strand concentrations of about 1 mM of the probe and 1 fM target, the algorithm used for calculating probe-target melting temperature has been adapted for use in predicting optimal INVADER assay reaction temperature. For a set of 30 probes, the average deviation between optimal assay temperatures calculated by this method and those experimentally determined is about 1.5° C.

The length of the downstream probe analyte-specific region (ASR) is defined by the temperature selected for running the reaction (e.g., 63° C.). Starting from the position of the variant nucleotide on the target DNA (the target base that is paired to the probe nucleotide 5' of the intended cleavage site), and adding on the 3' end, an iterative procedure is used by which the length of the target-binding region of the probe is increased by one base pair at a time until a calculated optimal reaction temperature ($T_m$ plus salt correction to compensate for enzyme effect) matching the desired reaction temperature is reached. The non-complementary arm of the probe is preferably selected to allow the secondary reaction to cycle at the same reaction temperature. The entire probe oligonucleotide is screened using programs such as mfold (Zuker, Science, 244: 48 [1989]) or Oligo 5.0 (Rychlik and Rhoads, Nucleic Acids Res, 17: 8543 [1989]) for the possible formation of dimer complexes or secondary structures that could interfere with the reaction. The same principles are also followed for INVADER oligonucleotide design. Briefly, starting from the position N on the target DNA, the 3' end of the INVADER oligonucleotide is designed to have a nucleotide not complementary to either allele suspected of being contained in the sample to be tested. The mismatch does not adversely affect cleavage (Lyamichev et al., Nature Biotechnology, 17: 292 [1999]), and it can enhance probe cycling, presumably by minimizing coaxial stabilization effects between the two probes. Additional residues complementary to the target DNA starting from residue N−1 are then added in the 5' direction until the stability of the INVADERoligonucleotide-target hybrid exceeds that of the probe (and therefore the planned assay reaction temperature), generally by 15–20° C.

In some embodiments, the released cleavage fragment from a primary reaction is to be used in a secondary reaction. It is one aspect of the assay design that the all of the probe sequences may be selected to allow the primary and secondary reactions to occur at the same optimal temperature, so that the reaction steps can run simultaneously. In an alternative embodiment, the probes may be designed to operate at different optimal temperatures, so that the reaction steps are not simultaneously at their temperature optima.

Figure 44:
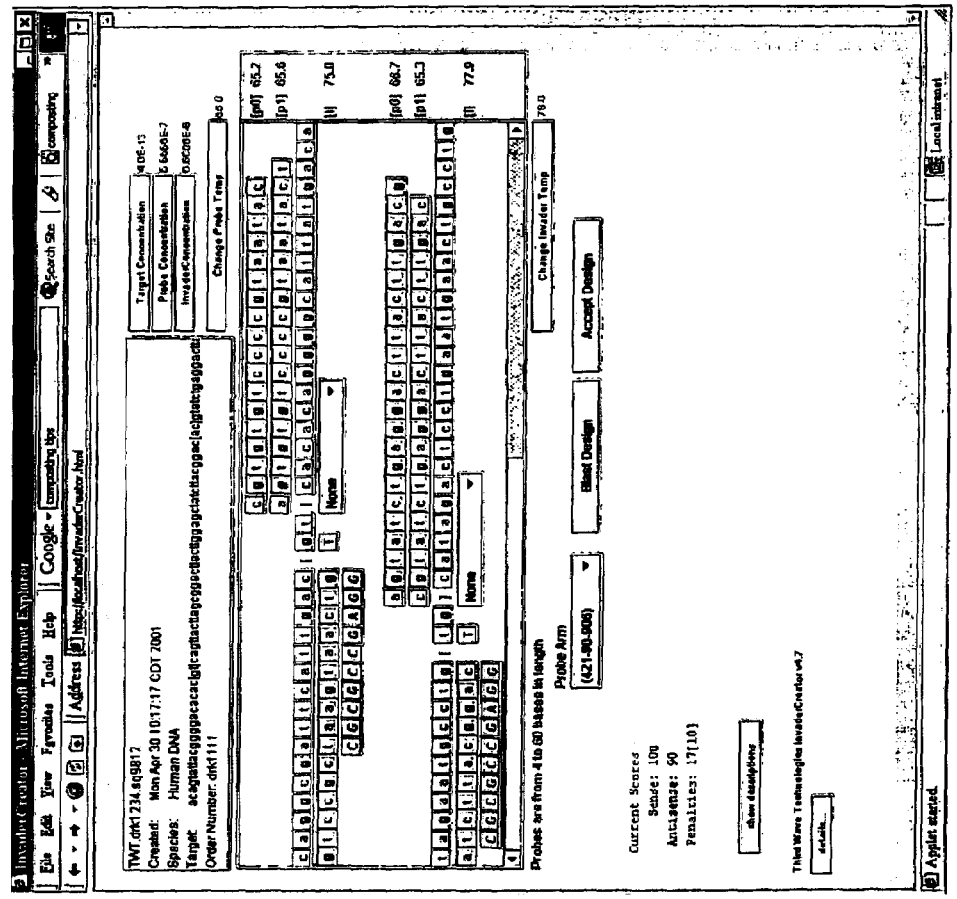
FIG. 44 shows a computer display of an INVADERCREATOR Designer Worksheet screen.

In some embodiments, the software provides the user an opportunity to change various aspects of the design including but not limited to: probe, target and INVADER oligonucleotide temperature optima and concentrations; blocking groups; probe arms; dyes, capping groups and other adducts; individual bases of the probes and targets (e.g., adding or deleting bases from the end of targets and/or probes, or changing internal bases in the INVADER and/or probe and/or target oligonucleotides). In some embodiments, changes are made by selection from a menu. In other embodiments, changes are entered into text or dialog boxes. In preferred embodiments, this option opens a new screen (e.g., a Designer Worksheet view, FIG. 44).

In some embodiments, the software provides a scoring system to indicate the quality (e.g., the likelihood of performance) of the assay designs. In one embodiment, the scoring system includes a starting score of points (e.g., 100 points) wherein the starting score is indicative of an ideal design, and wherein design features known or suspected to have an adverse affect on assay performance are assigned penalty values. Penalty values may vary depending on assay parameters other than the sequences, including but not limited to the type of assay for which the design is intended (e.g., monoplex, multiplex) and the temperature at which the assay reaction will be performed. The following example provides illustrative scoring criteria for use with some embodiments of the INVADER assay based on an intelligence defined by experimentation. Examples of design features that may incur score penalties include but are not limited to the following [penalty values are indicated in brackets, first number is for lower temperature assays (e.g., 62–64° C.), second is for higher temperature assays (e.g., 65–66° C.)]:

1. [100:100] 3' end of INVADER oligonucleotide resembles the probe arm:
   ARM SEQUENCE: PENALTY AWARDED IF INVADER OLIGONUCLEOTIDE ENDS IN:

Arm 1:
CGCGCCGAGG    5' . . . GAGGX or 5' . . . GAGGXX

-continued

Arm 2:
ATGACGTGGCAGAC    5' . . . CAGACX or 5' . . . CAGACXX

Arm 3:
ACGGACGCGGAG    5' . . . GGAGX or 5' . . . GGAGXX

Arm 4:
TCCGCGCGTCC    5' . . . GTCCX or 5' . . . GTCCXX

2. [70:70] a probe has 5-base stretch (i.e., 5 of the same base in a row) containing the polymorphism;
3. [60:60] a probe has 5-base stretch adjacent to the polymorphism;
4. [50:50] a probe has 5-base stretch one base from the polymorphism;
5. [40:40] a probe has 5-base stretch two bases from the polymorphism;
6. [50:50] probe 5-base stretch is of Gs—additional penalty;
7. [100:100] a probe has 6-base stretch anywhere;
8. [90:90] a two or three base sequence repeats at least four times;
9. [100:100] a degenerate base occurs in a probe;
10. [60:90] probe hybridizing region is short (13 bases or less for designs 65–67° C.; 12 bases or less for designs 62–64° C.)
11. [40:90] probe hybridizing region is long (29 bases or more for designs 65–67° C., 28 bases or more for designs 62–64° C.)
12. [5:5] probe hybridizing region length—per base additional penalty
13. [80:80] Ins/Del design with poor discrimination in first 3 bases after probe arm
14. [100:100] calculated INVADER oligonucleotide Tm within 7.5° C. of probe target Tm (designs 65–67° C. with INVADER oligonucleotide less than ≦70.5° C., designs 62–64° C. with INVADER oligonucleotide ≦69.5° C.
15. [20:20] calculated probes Tms differ by more than 2.0° C.
16. [100:100] a probe has calculated Tm 2° C. less than its target $T_m$
17. [10:10] target of one strand 8 bases longer than that of other strand
18. [30:30] INVADER oligonucleotide has 6-base stretch anywhere—initial penalty
19. [70:70] INVADER oligonucleotide 6-base stretch is of Gs—additional penalty
20. [15:15] probe hybridizing region is 14, 15 or 24–28 bases long (65–67° C.) or 13, 14 or 26, 27 bases long (62–64° C.)
21. [15:15] a probe has a 4-base stretch of Gs containing the polymorphism In particularly preferred embodiments, temperatures for each of the oligonucleotides in the designs are recomputed and scores are recomputed as changes are made. In some embodiments, score descriptions can be seen by clicking a "descriptions" button. In some embodiments, a BLAST search option is provided. In preferred embodiments, a BLAST search is done by clicking a "BLAST Design" button. In some embodiments, this action brings up a dialog box describing the BLAST process. In preferred embodiments, the BLAST search results are displayed as a highlighted design on a Designer Worksheet.

Figure 45:
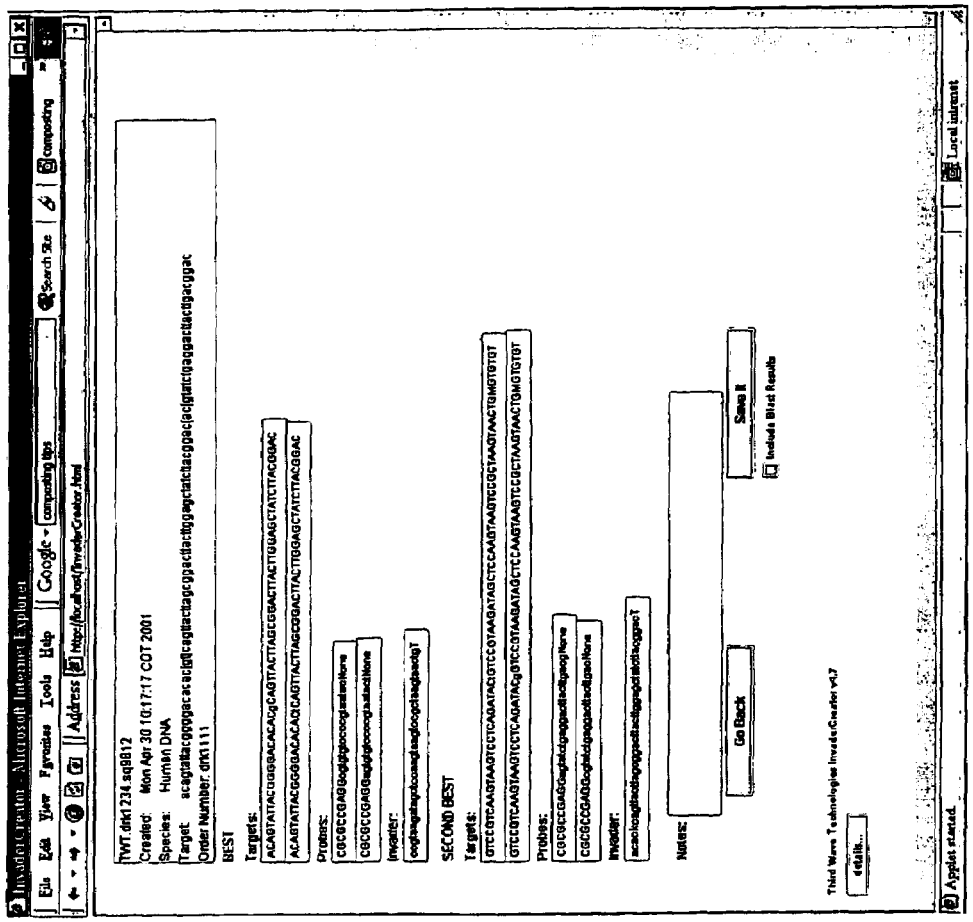
FIG. 45 shows a computer display of an INVADERCREATOR Output Page screen.

In some embodiments, a user accepts a design by clicking an "Accept" button. In other embodiments, the program approves a design without user intervention. In preferred embodiments, the program sends the approved design to a next process step (e.g., into production; into a file or database). In some embodiments, the program provides a screen view (e.g., an Output Page, FIG. 45), allowing review of the final designs created and allowing notes to be attached to the design. In preferred embodiments, the user can return to the Designer Worksheet (e.g., by clicking a "Go Back" button) or can save the design (e.g., by clicking a "Save It" button) and continue (e.g., to submit the designed oligonucleotides for production).

Figure 46:
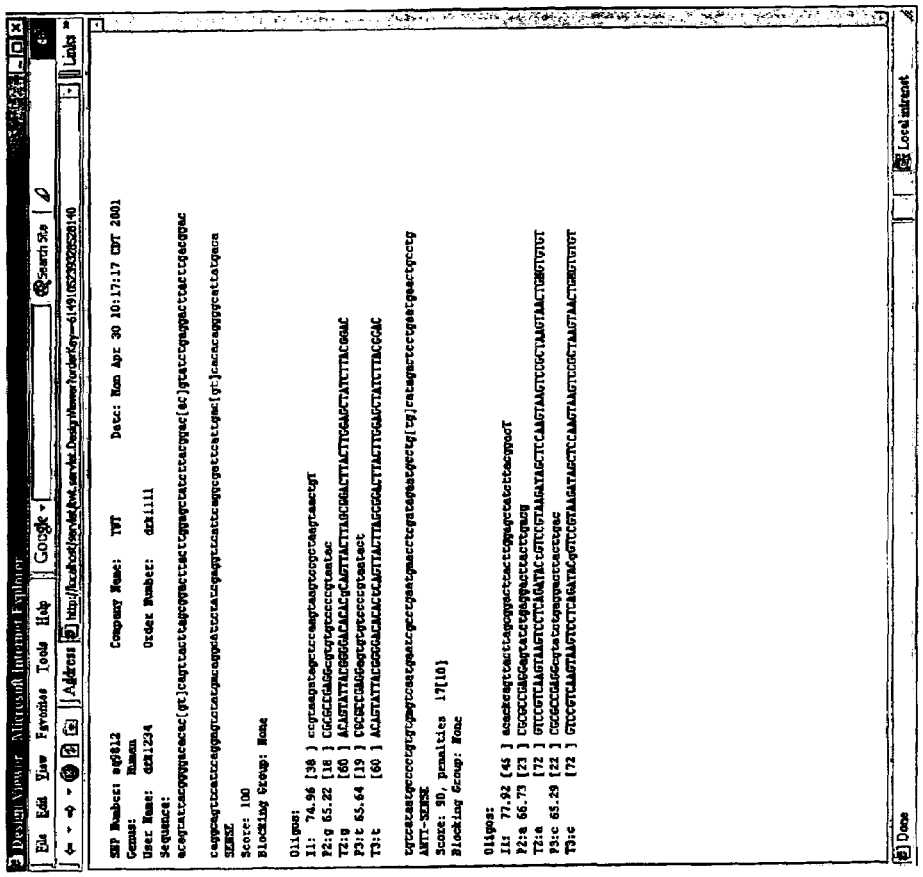
FIG. 46 shows a computer display of an INVADERCREATOR Printer Ready Output screen.

In some embodiments, the program provides an option to create a screen view of a design optimized for printing (e.g., a text-only view) or other export (e.g., an Output view, FIG. 46). In preferred embodiments, the Output view provides a description of the design particularly suitable for printing, or for exporting into another application (e.g., by copying and pasting into another application). In particularly preferred embodiments, the Output view opens in a separate window.

The present invention is not limited to the use of the INVADERCREATOR software. Indeed, a variety of software programs are contemplated and are commercially available, including, but not limited to GCG Wisconsin Package (Genetics computer Group, Madison, Wis.) and Vector NTI (Informax, Rockville, Md.).

b) Design of the Reaction Conditions

Target nucleic acids (e.g., RNA and DNA) that may be analyzed using the methods of the present invention that employ a 5' nuclease or other appropriate cleavage agents. Such nucleic acids may be obtained using standard molecular biological techniques. For example, nucleic acids (RNA or DNA) may be isolated from a tissue sample (e.g., a biopsy specimen), tissue culture cells, samples containing bacteria and/or viruses (including cultures of bacteria and/or viruses), etc. The target nucleic acid may also be transcribed in vitro from a DNA template or may be chemically synthesized or amplified in by polymerase chain reaction. Furthermore, nucleic acids may be isolated from an organism, either as genomic material or as a plasmid or similar extrachromosomal DNA, or they may be a fragment of such material generated by treatment with a restriction endonuclease or other cleavage agent, or a shearing force, or it may be synthetic.

Assembly of the target, probe, and INVADER oligonucleotide nucleic acids into the cleavage reaction of the present invention uses principles commonly used in the design of oligonucleotide-based enzymatic assays, such as dideoxynucleotide sequencing and polymerase chain reaction (PCR). As is done in these assays, the oligonucleotides are provided in sufficient excess that the rate of hybridization to the target nucleic acid is very rapid. These assays are commonly performed with 50 fmoles to 2 pmoles of each oligonucleotide per microliter of reaction mixture, although they are not necessarily limited to this range. In the Examples described herein, amounts of oligonucleotides ranging from 250 fmoles to 5 pmoles per microliter of reaction volume were used. These values were chosen for the purpose of ease in demonstration and are not intended to limit the performance of the present invention to these concentrations. Other (e.g., lower) oligonucleotide concentrations commonly used in other molecular biological reactions are also contemplated.

It is desirable that an INVADER oligonucleotide be immediately available to direct the cleavage of each probe oligonucleotide that hybridizes to a target nucleic acid. In some embodiments described herein, the INVADER oligonucleotide is provided in excess over the probe oligonucleotide. While this is an effective means of making the INVADER oligonucleotide immediately available in such embodiments it is not intended that the practice of the present invention be limited to conditions wherein the INVADER oligonucleotide is in excess over the probe, or to any particular ratio of INVADER-to-probe (e.g., in some preferred embodiments described herein, the probe is provided in excess over the INVADER oligonucleotide). Another means of assuring the presence of an INVADER oligonucleotide whenever a probe binds to a target nucleic acid is to design the INVADER oligonucleotide to hybridize more stably to the target, i.e., to have a higher $T_m$ than the probe. This can be accomplished by any of the means of increasing nucleic acid duplex stability discussed herein (e.g. by increasing the amount of complementarity to the target nucleic acid).

Buffer conditions should be chosen that are compatible with both the oligonucleotide/target hybridization and with the activity of the cleavage agent. The optimal buffer conditions for nucleic acid modification enzymes, and particularly DNA modification enzymes, generally included enough mono- and di-valent salts to allow association of nucleic acid strands by base-pairing. If the method of the present invention is performed using an enzymatic cleavage agent other than those specifically described here, the reactions may generally be performed in any such buffer reported to be optimal for the nuclease function of the cleavage agent. In general, to test the utility of any cleavage agent in this method, test reactions are performed wherein the cleavage agent of interest is tested in the $MOPS/MnCl_2/KCl$ buffer or Mg-containing buffers described herein and in whatever buffer has been reported to be suitable for use with that agent, in a manufacturer's data sheet, a journal article, or in personal communication.

The products of the INVADER oligonucleotide-directed cleavage reaction are fragments generated by structure-specific cleavage of the input oligonucleotides. The resulting cleaved and/or uncleaved oligonucleotides may be analyzed and resolved by a number of methods including, but not limited to, electrophoresis (on a variety of supports including acrylamide or agarose gels, paper, etc.), chromatography, fluorescence polarization, mass spectrometry and chip hybridization. In some Examples the invention is illustrated using electrophoretic separation for the analysis of the products of the cleavage reactions. However, it is noted that the resolution of the cleavage products is not limited to electrophoresis. Electrophoresis is chosen to illustrate the method of the invention because electrophoresis is widely practiced in the art and is easily accessible to the average practitioner. In other Examples, the invention is illustrated without electrophoresis or any other resolution of the cleavage products.

The probe and INVADER oligonucleotides may contain a label to aid in their detection following the cleavage reaction. The label may be a radioisotope (e.g., a $^{32}P$ or $^{35}S$-labelled nucleotide) placed at either the 5' or 3' end of the oligonucleotide or alternatively, the label may be distributed throughout the oligonucleotide (i.e., a uniformly labeled oligonucleotide). The label may be a nonisotopic detectable moiety, such as a fluorophore, that can be detected directly, or a reactive group that permits specific recognition by a secondary agent. For example, biotinylated oligonucleotides may be detected by probing with a streptavidin molecule that is coupled to an indicator (e.g., alkaline phosphatase or a fluorophore) or a hapten such as dioxigenin may be detected using a specific antibody coupled to a similar indicator. The reactive group may also be a specific configuration or sequence of nucleotides that can bind or otherwise interact with a secondary agent, such as another nucleic acid, and enzyme, or an antibody. In some embodiments, a probe is labeled with fluorescing moiety and a quenching moiety, wherein cleavage of the cleavage structure separates the fluorescing moiety from the quenching moiety, resulting in a detectable signal (e.g., FRET detection). In some embodiments, a change in quenching of signal from a donor fluorophor is detected, while in other embodiments, a change in emission from an acceptor fluorophore is detected. In still other embodiments, the effect of FRET on both donor and acceptor emissions are detected.

In some embodiments of FRET detection, the fluorescence lifetime of the fluorescence emitter is measured (e.g., as in time-resolved fluorescence). While not limiting time-resolved fluorescence detection embodiments to any particular labeling systems, examples of tags that are useful in time-resolved FRET measurements include europium chelate ($Eu^{3+}$; Biosclair, et al, J. Biomolecular Screening 5(5): 319 [2000]), europium trisbipyridine cryptate ($TBPEu^{3+}$; Alpha-Bazin, et al., Anal. Biochem. 286(1):17 [2000]), and ruthenium ligand complex $\{[Ru(bpy)2(phen-ITC)]^{2+}$; Youn, et al, Anal. Biochem. 232(1):24 [1995]; Lakowicz, et al., Anal. Biochem. 288:62 [2001]).

c) Optimization of Reaction Conditions

The INVADER oligonucleotide-directed cleavage reaction is useful to detect the presence of specific nucleic acids. In addition to the considerations listed above for the selection and design of the INVADER and probe oligonucleotides, the conditions under which the reaction is to be performed may be optimized for detection of a specific target sequence.

One objective in optimizing the INVADER oligonucleotide-directed cleavage assay is to allow specific detection of the fewest copies of a target nucleic acid. To achieve this end, it is desirable that the combined elements of the reaction interact with the maximum efficiency, so that the rate of the reaction (e.g., the number of cleavage events per minute) is maximized. Elements contributing to the overall efficiency of the reaction include the rate of hybridization, the rate of cleavage, and the efficiency of the release of the cleaved probe.

The rate of cleavage will be a function of the cleavage means chosen, and may be made optimal according to the manufacturer's instructions when using commercial preparations of enzymes or as described in the examples herein. The other elements (rate of hybridization, efficiency of release) depend upon the execution of the reaction, and optimization of these elements is discussed below.

Three elements of the cleavage reaction that significantly affect the rate of nucleic acid hybridization are the concentration of the nucleic acids, the temperature at which the cleavage reaction is performed and the concentration of salts and/or other charge-shielding ions in the reaction solution.

The concentrations at which oligonucleotide probes are used in assays of this type are well known in the art, and are discussed above. One example of a common approach to optimizing an oligonucleotide concentration is to choose a starting amount of oligonucleotide for pilot tests; 0.01 to 2 µM is a concentration range used in many oligonucleotide-based assays. When initial cleavage reactions are performed, the following questions may be asked of the data: Is the reaction performed in the absence of the target nucleic acid substantially free of the cleavage product?; Is the site of cleavage specifically positioned in accordance with the design of the INVADER oligonucleotide?; Is the specific cleavage product easily detected in the presence of the uncleaved probe (or is the amount of uncut material overwhelming the chosen visualization method)?

A negative answer to any of these questions would suggest that the probe concentration is too high, and that a set of reactions using serial dilutions of the probe should be performed until the appropriate amount is identified. Once identified for a given target nucleic acid in a give sample type (e.g., purified genomic DNA, body fluid extract, lysed bacterial extract), it should not need to be re-optimized. The sample type is important because the complexity of the material present may influence the probe concentration optimum.

Conversely, if the chosen initial probe concentration is too low, the reaction may be slow, due to inefficient hybridization. Tests with increasing quantities of the probe will identify the point at which the concentration exceeds the optimum (e.g., at which it produces an undesirable effect, such as background cleavage not dependent on the target sequence, or interference with detection of the cleaved products). Since the hybridization will be facilitated by excess of probe, it is desirable, but not required, that the reaction be performed using probe concentrations just below this point.

The concentration of INVADER oligonucleotide can be chosen based on the design considerations discussed above. In some embodiments, the INVADER oligonucleotide is in excess of the probe oligonucleotide. In a preferred embodiment, the probe oligonucleotide is in excess of the INVADER oligonucleotide.

Temperature is also an important factor in the hybridization of oligonucleotides. The range of temperature tested will depend in large part on the design of the oligonucleotides, as discussed above. Where it is desired to have a reaction be run at a particular temperature (e.g., because of an enzyme requirement, for convenience, for compatibility with assay or detection apparatuses, etc.), the oligonucleotides that function in the reaction can be designed to optimally perform at the desired reaction temperature. Each INVADER reaction includes at least two target sequence-specific oligonucleotides for the primary reaction: an upstream INVADER oligonucleotide and a downstream probe oligonucleotide. In some preferred embodiments, the INVADER oligonucleotide is designed to bind stably at the reaction temperature, while the probe is designed to freely associate and disassociate with the target strand, with cleavage occurring only when an uncut probe hybridizes adjacent to an overlapping INVADER oligonucleotide. In preferred embodiments, the probe includes a 5' flap that is not complementary to the target, and this flap is released from the probe when cleavage occurs. The released flap can be detected directly or indirectly. In some preferred embodiments, as discussed in detail below, the released flap participate as in INVADER oligonucleotide in a secondary reaction.

Optimum conditions for the INVADER assay are generally those that allow specific detection of the smallest amount of a target nucleic acid. Such conditions may be characterized as those that yield the highest target-dependent signal in a given timeframe, or for a given amount of target nucleic acid, or that allow the highest rate of probe cleavage (i.e., probes cleaved per minute).

As noted above, the concentration of the cleavage agent can affect the actual optimum temperature for a cleavage reaction. Additionally, different cleavage agents, even if used at identical concentrations, can affect reaction temperature optima differently (e.g., the difference between the calculated probe $T_m$ and the observed optimal reaction temperature may be greater for one enzyme than for another). Determination of appropriate salt corrections for reactions using different enzymes or concentrations of enzymes, or for any other variation made in reaction conditions, involves a two step process of a) measuring reaction temperature optima under the new reaction conditions, and varying the salt concentration within the $T_m$ algorithm to produce a calculated temperature matching or closely approximating the observed optima. Measurement of an optimum reaction temperature generally involves performing reactions at a range of temperatures selected such that the range allows observation of an increase in performance as an optimal temperature is approached (either by increasing or decreasing temperatures), and a decrease in performance when an optimal temperature has been passed, thereby allowing identification of the optimal temperature or temperature range (See e.g., Lyamichev, et al., Biochemistry 39: 9523 [2000]).

In some embodiments, a secondary reaction is used where the released cleavage fragment from a primary reaction hybridizes to a synthetic cassette to form a secondary cleavage reaction. In some preferred embodiments, the cassette comprises a fluorescing moiety and a quenching moiety, wherein cleavage of the secondary cleavage structure separates the fluorescing moiety from the quenching moiety, resulting in a detectable signal (e.g., FRET detection). The secondary reaction can be configured a number of different ways. For example, in some embodiments, the synthetic cassette comprises two oligonucleotides: an oligonucleotide that contains the FRET moieties and a FRET/INVADER oligonucleotide bridging oligonucleotide that allows the INVADER oligonucleotide (i.e., the released flap from the primary reaction) and the FRET oligonucleotide to hybridize thereto, such that a cleavage structure is formed. In some embodiments, the synthetic cassette is provided as a single oligonucleotide, comprising a hairpin structure (i.e., the FRET oligonucleotide is connected at its 3' end to the bridging oligonucleotide by a loop). The loop may be nucleic acid, or a non-nucleic acid spacer or linker. The linked molecules may together be described as a FRET cassette. In the secondary reaction using a FRET cassette the released flap from the primary reaction, which acts as an INVADER oligonucleotide, should be able to associate and disassociate with the FRET cassette freely, so that one released flap can direct the cleavage of multiple FRET cassettes. It is one aspect of the assay design that all of the probe sequences may be selected to allow the primary and secondary reactions to occur at the same optimal temperature, so that the reaction steps can run simultaneously. In an alternative embodiment, the probes may be designed to operate at different optimal temperatures, so that the reaction steps are not simultaneously at their temperature optima. As noted above, the same iterative process used to select the ASR of the probe can be used in the design of the portion of the primary probe that participates in a secondary reaction.

Another determinant of hybridization efficiency is the salt concentration of the reaction. In large part, the choice of solution conditions will depend on the requirements of the cleavage agent, and for reagents obtained commercially, the manufacturer's instructions are a resource for this information. When developing an assay utilizing any particular cleavage agent, the oligonucleotide and temperature optimizations described above should be performed in the buffer conditions best suited to that cleavage agent.

In some embodiments, additional agents may be included in reaction mixtures to enhance assay performance. For example, charged compounds such as aminoglycosides and other polyamines have been used to modulate DNA and RNA conformation and function (see, e.g., Earnshaw and Gait, Nucl. Acids Res. 26:5551 [1998]; Robinson and Wang, Nucl. Acids Res. 24:676 [1996]; Jerinie, J. Mol. Biol. 304(5):707 [2000]; Schroeder et al., EMBO 19(1):1 [2000]). Inclusion of the aminoglycoside antibiotic neomycin sulfate (e.g., at 1 µM in a primary reaction) can enhance assay performance by, e.g., reducing background signal, and therefore reducing the limit of detection of a particular INVADER assay probe set. Compounds of this type that may find use in INVADER assay reactions include, but are not limited to, aminoglycosides, oligomerized aminoglycosides, and aminoglycoside bioconjugates, and other polyanions including, but not limited to, spermine and hexaamine cobalt.

A "no enzyme" control allows the assessment of the stability of the labeled oligonucleotides under particular reaction conditions, or in the presence of the sample to be tested e.g., in assessing the sample for contaminating nucleases). In this manner, the substrate and oligonucleotides are placed in a tube containing all reaction components, except the enzyme and treated the same as the enzyme-containing reactions. Other controls may also be included. For example, a reaction with all of the components except the target nucleic acid will serve to confirm the dependence of the cleavage on the presence of the target sequence.

d) Selection of a Cleavage Agent

As demonstrated in a number of the Examples, some 5' nucleases do not require an upstream oligonucleotide to be active in a cleavage reaction. Although cleavage may be slower without the upstream oligonucleotide, it may still occur (Lyamichev et al., Science 260:778 [1993], Kaiser et al., J. Biol. Chem., 274:21387 [1999]). When a DNA strand is the template or target strand to which probe oligonucleotides are hybridized, the 5' nucleases derived from DNA polymerases and some flap endonucleases (FENs), such as that from Methanococcus jannaschii, can cleave quite well without an upstream oligonucleotide providing an overlap (Lyamichev et al., Science 260:778 [1993], Kaiser et al., J. Biol. Chem., 274:21387 [1999], and U.S. Pat. No. 5,843,669, herein incorporated by reference in its entirety). These nucleases may be selected for use in some embodiments of the INVADER assay, e.g., in embodiments wherein cleavage of the probe in the absence of an INVADER oligonucleotide gives a different cleavage product, which does not interfere with the intended analysis, or wherein both types of cleavage, INVADER oligonucleotide-directed and INVADER oligonucleotide-independent, are intended to occur.

In other embodiments it is preferred that cleavage of the probe be dependent on the presence of an upstream INVADER oligonucleotide, and enzyme having this requirement would be used. Other FENs, such as those from *Archeaoglobus fulgidus* (Afu) and *Pyrococcus furiosus* (Pfu), cleave an overlapped structure on a DNA target at so much greater a rate than they do a non-overlapping structure (i.e., either missing the upstream oligonucleotide or having a non-overlapping upstream oligonucleotide) that they can be viewed as having an essentially absolute requirement for the overlap (Lyamichev et al., Nat. Biotechnol., 17:292 [1999], Kaiser et al., J. Biol. Chem., 274:21387 [1999]). When an RNA target is hybridized to DNA oligonucleotide probes to form a cleavage structure, many FENs cleave the downstream DNA probe poorly, regardless of the presence of an overlap. On such an RNA-containing structure, the 5' nucleases derived from DNA polymerases have a strong requirement for the overlap, and are essentially inactive in its absence. The selection of enymes for use in the detection of RNA targets is discussed in more detail below, in Section IV: Improved Enzymes For Use In INVADER Oligonucleotide-Directed Cleavage Reactions Comprising RNA Targets.

e) Probing for Multiple Alleles

The INVADER oligonucleotide-directed cleavage reaction is also useful in the detection and quantification of individual variants or alleles in a mixed sample population. By way of example, such a need exists in the analysis of tumor material for mutations in genes associated with cancers. Biopsy material from a tumor can have a significant complement of normal cells, so it is desirable to detect mutations even when present in fewer than 5% of the copies of the target nucleic acid in a sample. In this case, it is also desirable to measure what fraction of the population carries the mutation. Similar analyses may also be done to examine allelic variation in other gene systems, and it is not intended that the method of the present invention by limited to the analysis of tumors.

As demonstrated below, in one embodiment, reactions can be performed under conditions that prevent the cleavage of probes bearing even a single-nucleotide difference mismatch, but that permit cleavage of a similar probe that is completely complementary to the target in this region. In a preferred embodiment, a mismatch is positioned at the nucleotide in the probe that is 5' of the site where cleavage occurs in the absence of the mismatch.

In other embodiments, the INVADER assay may be performed under conditions that have a tight requirement for an overlap (e.g., using the Afu FEN for DNA target detection or the 5' nuclease of DNA polymerase for RNA target detection, as described above), providing an alternative means of detecting single nucleotide or other sequence variations. In one embodiment, the probe is selected such that the target base suspected of varying is positioned at the 5' end of the target-complementary region of this probe. The upstream INVADER oligonucleotide is positioned to provide a single base of overlap. If the target and the probe oligonucleotide are complementary at the base in question, the overlap forms and cleavage can occur. However, if the target does not complement the probe at this position, that base in the probe becomes part of a non-complementary 5' arm, no overlap between the INVADER oligonucleotide and probe oligonucleotide exists, and cleavage is suppressed.

It is also contemplated that different sequences may be detected in a single reaction. Probes specific for the different sequences may be differently labeled. For example, the probes may have different dyes or other detectable moieties, different lengths, or they may have differences in net charges of the products after cleavage. When differently labeled in one of these ways, the contribution of each specific target sequence to final product can be tallied. This has application in detecting the quantities of different versions of a gene within a mixture. Different genes in a mixture to be detected and quantified may be wild type and mutant genes (e.g., as may be found in a tumor sample, such as a biopsy). In this embodiment, one might design the probes to precisely the same site, but one to match the wild-type sequence and one to match the mutant. Quantitative detection of the products of cleavage from a reaction performed for a set amount of time will reveal the ratio of the two genes in the mixture. Such analysis may also be performed on unrelated genes in a mixture. This type of analysis is not intended to be limited to two genes. Many variants within a mixture may be similarly measured.

Alternatively, different sites on a single gene may be monitored and quantified to verify the measurement of that gene. In this embodiment, the signal from each probe would be expected to be the same.

It is also contemplated that multiple probes may be used that are not differently labeled, such that the aggregate signal is measured. This may be desirable when using many probes designed to detect a single gene to boost the signal from that gene. This configuration may also be used for detecting unrelated sequences within a mix. For example, in blood banking it is desirable to know if any one of a host of infectious agents is present in a sample of blood. Because the blood is discarded regardless of which agent is present, different signals on the probes would not be required in such an application of the present invention, and may actually be undesirable for reasons of confidentiality.

Just as described for the two-oligonucleotide system, above, the specificity of the detection reaction will be influenced by the aggregate length of the target nucleic acid sequences involved in the hybridization of the complete set of the detection oligonucleotides. For example, there may be applications in which it is desirable to detect a single region within a complex genome. In such a case the set of oligonucleotides may be chosen to require accurate recognition by hybridization of a longer segment of a target nucleic acid, often in the range of 20 to 40 nucleotides. In other instances it may be desirable to have the set of oligonucleotides interact with multiple sites within a target sample. In these cases one approach would be to use a set of oligonucleotides that recognize a smaller, and thus statistically more common, segment of target nucleic acid sequence.

In one preferred embodiment, the INVADER and stacker oligonucleotides may be designed to be maximally stable, so that they will remain bound to the target sequence for extended periods during the reaction. This may be accomplished through any one of a number of measures well known to those skilled in the art, such as adding extra hybridizing sequences to the length of the oligonucleotide (up to about 50 nts in total length), or by using residues with reduced negative charge, such as phosphorothioates or peptide-nucleic acid residues, so that the complementary strands do not repel each other to degree that natural strands do. Such modifications may also serve to make these flanking oligonucleotides resistant to contaminating nucleases, thus further ensuring their continued presence on the target strand during the course of the reaction. In addition, the INVADER and stacker oligonucleotides may be covalently attached to the target (e.g., through the use of psoralen cross-linking).

f) Applications for Pooled DNA and RNA Samples

In some embodiments, the present invention provides methods and kits for assaying a pooled sample using INVADER detection reagents (e.g. primary probe, INVADER probe, and FRET cassette). In some preferred embodiments, the kit comprises instructions on how to perform the INVADER assay and specifically how to apply the INVADER detection assay to pooled samples from many individuals, or to "pooled" samples from many cells (e.g. from a biopsy sample) from a single subject.

In particular embodiments, the present invention allows detection of polymorphims in pooled samples combined from many individuals in a population (e.g. 10, 50, 100, or 500 individuals), or from a single subject where the nucleic acid sequences are from a large number of cells that are assayed at once. In this regard, the present invention allows the frequency of rare mutations in pooled samples to be detected and an allele frequency for the population established. In some embodiments, this allele frequency may then be used to statistically analyze the results of applying the INVADER detection assay to an individual's frequency for the polymorphism (e.g. determined using the INVADER assay). In this regard, mutations that rely on a percent of mutants found (e.g. loss of heterozygozity mutations) may be analyzed, and the severity of disease or progression of a disease determined (See, e.g. U.S. Pat. Nos. 6,146,828 and 6,203,993 to Lapidus, hereby incorporated by reference for all purposes, where genetic testing and statistical analysis are employed to find disease causing mutations or identify a patient sample as containing a disease causing mutations).

In some embodiments of the present invention, broad population screens are performed. In some preferred embodiments, pooling DNA from several hundred or a thousand individuals is optimal. In such a pool, for example, DNA from any one individual would not be detectable, and any detectable signal would provide a measure of frequency of the detected allele in a broader population. The amount of DNA to be used, for example, would be set not by the number of individuals in a pool, but rather by the allele frequency to be detected. For example, in some embodiments, an assay gives ample signal from 20 to 40 ng of DNA in a 90 minute reaction. At this level of sensitivity, analysis of 1 μg of DNA from a high-complexity pool would produce comparable signal from alleles present in only about 3–5% of the population.

g) Applications of RNA Detection.

RNA quantitation is becoming increasingly important in basic, pharmaceutical, and clinical research. For example, quantitation of viral RNAs can predict disease progression and therapeutic efficacy. Likewise, gene expression analysis of diseased vs. normal, or untreated vs. treated, tissue can identify relevant biological responses or assess the effects of pharmacological agents. As the focus of the Human Genome Project moves toward gene expression analysis, the field will require a flexible RNA analysis technology that can quantitatively monitor multiple forms of alternatively transcribed and/or processed RNAs.

As decribed above for the detection of multiple alleles, multiplex formats of the RNA INVADER assay enable simultaneous expression analysis of two or more genes within the same sample. In a primary reaction, one-nucleotide overlap-substrates are generated by the hybridization of INVADER oligonucleotides and probe oligonucleotides to their respective RNA targets. Each probe contains a specific, target-complementary region and a distinctive non-complementary 5' flap that is associated only with that specific mRNA in that assay. The distinctive flaps may be distinguished in any of the myriad ways disclosed herein (e.g., with different labels, different secondary cleavage systems having different labels, specific antibodies, different sizes when resolved, differenct sequences detected by hybridization in solution or on surfaces, etc.)

While the RNA invasive cleavage assay, like the method used for DNA detection described above, can use two invasive cleavage reactions in sequence (described below, in Section II of the Detailed Description of the Invention), its preference for the 5' nucleases derived from DNA polymerases (described in detail in Section IV of the Detailed Description of the Invention) indicates that additional format changes are preferred. Unlike the FEN 5' nucleases generally used for detection of DNA targets, optimal signal amplification with the DNA Pol-related 5' nucleases occurs only when a probe turnover mechanism is employed in both the primary and secondary reactions (in contrast to an INVADER oligonucleotide turnover mechanism, wherein an INVADER oligonucleotide cycles, e.g., to direct the cleavage of multiple FRET cassettes, as described below, in Section II of this Detailed Description). Consequently, in preferred embodiments, RNA detection uses sequential operation of the two reactions, rather than simultaneous reaction performance. Because the reactions are performed truly sequentially, in these embodiments, the RNA INVADER assay signal accumulates linearly in both a target- and time-dependent manner. In contrast, the primary and secondary reactions of the DNA INVADER assay, when run concurrently, amplify signal as a linear function of target level, but as a quadratic function of time. In the sequential embodiments, the RNA INVADER assay uses two separate oligonucleotides, a secondary probe (e.g., a FRET probe) and secondary target, for signal generation.

A key feature of the RNA invasive cleavage assay is its ability to discriminate highly homologous RNA sequences, such as those found in cytochrome P450 gene families. Like the DNA INVADER assay, the RNA INVADER assay can discriminate single-base changes. In some embodiments, the first 5' complementary base of each probe is positioned at a non-conserved site in its mRNA target, so that a mismatch prevents formation of the overlap-structure, and thus prevents cleavage of the probe. Alternatively spliced mRNA variants can be specifically detected by positioning the cleavage site at a splice junction.

To monitor large changes in mRNA levels, the dynamic range of the assay can be extended using real-time analysis. However, since the assay generates signal linearly with time or target level, simply varying the amount of sample added per reaction and calculating the copies of mRNA per ng total RNA enables accurate quantitation with a single endpoint measurement on low-cost instrumentation. Further, in cases where absolute quantitation is not necessary, the assay's linear signal amplification mechanism and reproducibility also eliminate the need for a standard curve and enable simple and precise relative quantitation of any one gene.

The RNA INVADER assay is particularly suited for detecting alternatively spliced or edited RNA variants because even a single base change at the overlap site affects 5' nuclease cleavage. All areas requiring RNA quantitation, such as high-throughput screening in drug discovery research, monitoring drug metabolism and safety in clinical trials, and clinical load monitoring of viral RNA can use this technology. Splice variants can be monitored in at least two ways with the assay: 1) detection of an individual exon or 2) detection of a specific splice junction.

To examine an RNA population for variants having more or fewer exons after splicing, INVADER assay probe sets are designed for each of the exons of interest (or for all exons in the mature RNA). Quantitation of exons, independent of how many mRNAs they reside in, may provide information about the number of splice variants for a given gene, as well as indicate the levels of expression for each exon. Mini in vitro transcripts containing only one or a few exons can be generated for each probe set so that absolute quantitation can be performed for each exon, thus enabling accurate comparisons of exon levels. If it is known that a particular exon is present in all known variants, in some embodiments, a probe set is designed for that exon for use as an internal control to normalize across different samples. RNAs having a one copy of each exon (e.g., "normally spliced" RNA) should produce signal from the collection of probe sets in certain relative amounts (which should be esseintially equal for all exons, corrected for variations in the sensitivity of individual probe sets; see Section V). Alterations in splicing alter the relative amounts of the exons. For example, if all of the produced RNAs are missing one of the normal exons, the signal for that exon drops toward zero, while if half of the RNAs are missing that exon, the signal for that exon drops toward 50%. More complex combinations of splice variations and mixtures of differently spliced mRNAs yield more complex and more informative profiles. Detection is not limited to exons. RNA populations may also be monitored for the presence of intron sequences that are usually removed by splicing. Such global exon screening provides biologically relevant or diagnostic information when comparing normal vs. diseased tissue or untreated vs. treated cells (e.g., in pharmacogenomic screening assays). An array-based description of this type of measurement is referred to as alternative splicing detector arrays (D. Black, Cell 103: 367 [2000]). It is contemplated that the mRNA INVADER assay gives similar results but with greater specificity and more accurate quantitation than the oligonucleotide array formats.

In an alternative embodiment, alternatively spliced mRNAs is detected by examiniation of specific splice junctions. The advantage of monitoring the splice sites, as opposed to the exons themselves, is that even splice variants involving very small exons (e.g. <10 nts) are accurately detected with the assay.

Additionally, in some embodiments, the mRNA INVADER assay isalso used to monitor alternative start and stop sites in the mRNA, and is used to monitor lifetimes of processed and unprocessed RNAs and RNA fragments (e.g., as used in timecourse studies following induction).

II. Signal Enhancement by Incorporating the Products of an Invasive Cleavage Reaction into a Subsequent Invasive Cleavage Reaction As noted above, the oligonucleotide product released by the invasive cleavage can be used subsequently in any reaction or read-out method that uses oligonucleotides in the size range of a cleavage product. In addition to the reactions involving primer extension and transcription, described herein, another enzymatic reaction that makes use of oligonucleotides is the invasive cleavage reaction. The present invention provide means of using the oligonucleotide released in a primary invasive cleavage reaction as a component to complete a cleavage structure to enable a secondary invasive cleavage reaction. IT is not intended that the sequential use of the invasive cleavage product be limited to a single additional step. It is contemplated that many distinct invasive cleavage reactions may be performed in sequence.

The polymerase chain reaction uses a DNA replication method to create copies of a targeted segment of nucleic acid at a logarithmic rate of accumulation. This is made possible by the fact that when the strands of DNA are separated, each individual strand contains sufficient information to allow assembly of a new complementary strand. When the new strands are synthesized the number of identical molecules has doubled. Within 20 iterations of this process, the original may be copied 1 million-fold, making very rare sequences easily detectable. The mathematical power of a doubling reaction has been incorporated into a number of amplification assays.

By performing multiple, sequential invasive cleavage reactions the method of the present invention captures an exponential mathematical advantage without producing additional copies of the target analyte. In a simple invasive cleavage reaction the yield, Y, is simply the turnover rate, K, multiplied by the time of the reaction, t (i.e., $Y=(K)(t)$). If Y is used to represent the yield of a simple reaction, then the yield of a compound (i.e., a multiple, sequential reaction), assuming that each of the individual invasive cleavage steps has the same turnover rate, can be simply represented as $Y^n$, where n is the number of invasive cleavage reactions that have been performed in the series. If the yields of each step differ the ultimate yield can be represented as the product of the multiplication of the yields of each individual reaction in the series. For example, if a primary invasive cleavage reaction can produce one thousand products in 30 minutes, and each of those products can in turn participate in 1000 additional reactions, there will be $1000^2$ copies (1000×1000) of the ultimate product in a second reaction. If a third reaction is added to the series, then the theoretical yield will be $1000^3$ (1000×1000×1000). In the methods of the present invention the exponent comes from the number of invasive cleavage reactions in the cascade. This can be contrasted to the amplification methods described above (e.g., PCR) in which Y is limited to 2 by the number of strands in duplex DNA, and the exponent n is the number of cycles performed, so that many iterations are necessary to accumulate large amounts of product.

To distinguish the exponential amplifications described above from those of the present invention, the former can be considered reciprocating reactions because the products the reaction feed back into the same reaction (e.g., event one leads to some number of events 2, and each event 2 leads back to some number of events 1). In contrast, the events in some embodiments of the present invention are sequential (e.g., event 1 leads to some number of events 2; each event 2 leads to some number of events 3, etc., and no event can contribute to an event earlier in the chain).

The sensitivity of the reciprocating methods is also one of the greatest weaknesses when these assays are used to determine if a target nucleic acid sequence is present or absent in a sample. Because the product of these reactions is detectable copies of the starting material, contamination of a new reaction with the products of an earlier reaction can lead to false positive results, (i.e., the apparent detection of the target nucleic acid in samples that do not actually contain any of that target analyte). Furthermore, because the concentration of the product in each positive reaction is so high, amounts of DNA sufficient to create a strong false positive signal can be communicated to new reactions very easily either by contact with contaminated instruments or by aerosol. In contrast to the reciprocating methods, the most concentrated product of the sequential reaction (i.e., the product released in the ultimate invasive cleavage event) is not capable of initiating a like reaction or cascade if carried over to a fresh test sample. This is a marked advantage over the exponential amplification methods described above because the reactions of the present invention may be performed without the costly containment arrangements (e.g., either by specialized instruments or by separate laboratory space) required by any reciprocating reaction. While the products of a penultimate event may be inadvertently transferred to produce a background of the ultimate product in the absence of the a target analyte, the contamination would need to be of much greater volume to give an equivalent risk of a false positive result.

When the term sequential is used it is not intended to limit the invention to configurations in which that one invasive cleavage reaction or assay must be completed before the initiation of a subsequent reaction for invasive cleavage of a different probe. Rather, the term refers to the order of events as would occur if only single copies of each of the oligonucleotide species were used in an assay. The primary invasive cleavage reaction refers to that which occurs first, in response to the formation of the cleavage structure on the target nucleic acid. Subsequent reactions may be referred to as secondary, tertiary and so forth, and may involve artificial "target" strands that serve only to support assembly of a cleavage structure, and which are unrelated to the nucleic acid analyte of interest. While the complete assay may, if desired, be configured with each step of invasive cleavage separated either in space (e.g., in different reaction vessels) or in time (e.g., using a shift in reaction conditions, such as temperature, enzyme identity or solution condition, to enable the later cleavage events), it is also contemplated that all of the reaction components may be mixed so that secondary reactions may be initiated as soon as product from a primary cleavage becomes available. In such a format, primary, secondary and subsequent cleavage events involving different copies of the cleavage structures may take place simultaneously.

Several levels of this sort of linear amplification can be envisioned, in which each successive round of cleavage produces an oligonucleotide that can participate in the cleavage of a different probe in subsequent rounds. The primary reaction would be specific for the analyte of interest with secondary (and tertiary, etc.) reactions being used to generate signal while still being dependent on the primary reaction for initiation.

The released product may perform in several capacities in the subsequent reactions. For example, the product of one invasive cleavage reaction becomes the INVADER oligonucleotide to direct the specific cleavage of another probe in a second reaction. In such an example, the first invasive cleavage structure is formed by the annealing of the INVADER oligonucleotide and the probe oligonucleotide (Probe 1) to the first target nucleic acid (Target 1). The target nucleic acid is divided into three regions based upon which portions of the INVADER and probe oligonucleotides are capable of hybridizing to the target. Region 1 of the target has complementarity to only the INVADER oligonucleotide; region 3 of the target has complementarity to only the probe; and region 2 of the target has an overlap between the INVADER and probe oligonucleotides.

Cleavage of Probe 1 releases the "Cut Probe 1". The released Probe 1 is then used as the INVADER oligonucleotide in second cleavage. The second cleavage structure is formed by the annealing of the Cut Probe 1, a second probe oligonucleotide ("Probe 2") and a second target nucleic acid ("Target 2"). In some embodiments, Probe 2 and the second target nucleic acid are covalently connected, preferably at their 3' and 5' ends, respectively, thus forming a hairpin stem and loop, termed herein a "cassette". The loop may be nucleic acidor a non-nucleic acid spacer or linker. Inclusion of an excess of the cassette molecule allows each Cut Probe 1 to serve as an INVADER to direct the cleavage of multiple copies of the cassette.

Probe 2 may be labeled and detection of cleavage of the second cleavage structure may be accomplished by detecting the labeled cut Probe 2; the label may a radioisotope (e.g., $^{32}P$, $^{35}S$), a fluorophore (e.g., fluorescein), a reactive group capable of detection by a secondary agent (e.g., biotin/streptavidin), a positively charged adduct which permits detection by selective charge reversal (as discussed in Section IV above), etc. Alternatively, the cut Probe 2 may used in a tailing reaction, or to complete or activate a protein-binding site, or may be detected or used by any of the means for detecting or using an oligonucleotide described herein.

In other embodiments, probe oligonucleotides that are cleaved in the primary reaction can be designed to fold back on themselves (i.e., they contain a region of self-complementarity) to create a molecule that can serve as both the INVADER and target oligonucleotide (termed here an "IT complex). The IT complex then enables cleavage of a different probe present in the secondary reaction. Inclusion of an excess of the secondary probe molecule ("Probe 2"), allows each IT molecule to serve as the platform for the generation of multiple copies of cleaved secondary probe. The target nucleic acid is divided into three regions based upon which portions of the INVADER and probe oligonucleotides are capable of hybridizing to the target (as discussed above and it is noted that the target may be divided into four regions if a stacker oligonucleotide is employed). The second cleavage structure is formed by the annealing of the second probe ("Probe 2") to the fragment of Probe 1 ("Cut Probe 1") that was released by cleavage of the first cleavage structure. The Cut Probe 1 forms a hairpin or stem/loop structure near its 3' terminus by virtue of the annealing of the regions of self-complementarity contained within Cut Probe 1 (this self-annealed Cut Probe 1 forms the IT complex). The IT complex (Cut Probe 1) is divided into three regions. Region 1 of the IT complex has complementarity to the 3' portion of Probe 2; region 2 has complementarity to both the 3' end of Cut Probe 1 and to the 5' portion of Probe 2; and region 3 contains the region of self-complementarity (i.e., region 3 is complementary to the 3' portion of the Cut Probe 1). Note that with regard to the IT complex (i.e., Cut Probe 1), region 1 is located upstream of region 2 and region 2 is located upstream of region 3. As for other embodiments of invasive cleavage, region "2" can represent a region where there is a physical, but not sequence, overlap between the INVADER oligonucleotide portion of the Cut Probe 1 and the Probe 2 oligonucleotide.

The cleavage products of the secondary invasive cleavage reaction (i.e., Cut Probe 2) can either be detected, or can in turn be designed to constitute yet another integrated INVADER-target complex to be used with a third probe molecule, again unrelated to the preceding targets.

It is envisioned that the oligonucleotide product of a primary cleavage reaction may fill the role of any of the oligonucleotides described herein (e.g., it may serve as a target strand without an attached INVADER oligonucleotide-like sequence, or it may serve as a stacker oligonucleotide, as described above), to enhance the turnover rate seen in the secondary reaction by stabilizing the probe hybridization through coaxial stacking.

Secondary cleavage reactions in some preferred embodiments of the present invention include the use of FRET cassettes. Such molecules provide both a secondary target and a FRET labeled cleavable sequence, allowing homogeneous detection (i.e., without product separation or other manipulation after the reaction) of the sequential invasive cleavage reaction. Other preferred embodiments use a secondary reaction system in which the FRET probe and synthetic target are provided as separate oligonucleotides.

In a preferred embodiment, each subsequent reaction is facilitated by (i.e., is dependent upon) the product of the previous cleavage, so that the presence of the ultimate product may serve as an indicator of the presence of the target analyte. However, cleavage in the second reaction need not be dependent upon the presence of the product of the primary cleavage reaction; the product of the primary cleavage reaction may merely measurably enhance the rate of the second cleavage reaction.

In summary, the INVADER assay cascade (i.e., sequential invasive cleavage reactions) of the present invention is a combination of two or more linear assays that allows the accumulation of the ultimate product at an exponential rate, but without significant risk of carryover contamination. It is important to note that background that does not arise from sequential cleavage, such as thermal breakage of the secondary probe, generally increases linearly with time. In contrast, signal generation from a 2-step sequential reaction follows quadratic kinetics. Thus, collection of data as a time course, either by taking time points or through the use of an instrument that allows real-time detection during the INVADER assay reaction incubations, provides the attractive capability of discriminating between the true signal and any background solely on the basis of quadratic versus linear increases in signal over time. For example, when viewed graphically, the real signal will appear as a quadratic curve, while any accumulating background will be linear, and thus easy to distinguish, even if the absolute level of the background signal (e.g., fluorescence in a FRET detection format) is substantial.

The sequential invasive cleavage amplification of the present invention can be used as an intermediate boost to any of the detection methods (e.g., gel based analysis by either standard or by charge reversal), polymerase tailing, and incorporation into a protein binding region, described herein. When used is such combinations the increased production of a specific cleavage product in the invasive cleavage assay reduces the burdens of sensitivity and specificity on the read-out systems, thus facilitating their use.

In addition to enabling a variety of detection platforms, the cascade strategy is suitable for multiplex analysis of individual analytes (i.e., individual target nucleic acids) in a single reaction. The multiplex format can be categorized into two types. In one case, it is desirable to know the identity (and amount) of each of the analytes that can be present in a clinical sample, or the identity of each of the analytes as well as an internal control. To identify the presence of multiple individual analytes in a single sample, several distinct secondary amplification systems may be included. Each probe cleaved in response to the presence of a particular target sequence (or internal control) can be designed to trigger a different cascade coupled to different detectable moieties, such as different sequences to be extended by DNA polymerase or different dyes in an FRET format. The contribution of each specific target sequence to final product can thereby be tallied, allowing quantitative detection of different genes or alleles in a sample containing a mixture of genes or alleles.

In the second configuration, it is desirable to determine if any of several analytes are present in a sample, but the exact identity of each does not need to be known. For example, in blood banking it is desirable to know if any one of a host of infectious agents is present in a sample of blood. Because the blood is discarded regardless of which agent is present, different signals on the probes would not be required in such an application of the present invention, and may actually be undesirable for reasons of confidentiality. In this case, the 5' arms (i.e., the 5' portion that will be released upon cleavage) of the different analyte-specific probes would be identical and would therefore trigger the same secondary signal cascade. A similar configuration would permit multiple probes complementary to a single gene to be used to boost the signal from that gene or to ensure inclusivity when there are numerous alleles of a gene to be detected.

In the primary INVADER assay reaction, there are two potential sources of background. The first is from INVADER oligonucleotide-independent cleavage of probe annealed to the target, to itself, or to one of the other oligonucleotides present in the reaction. The use of an enzyme that cannot efficiently cleave a structure that lacks a primer is preferred for this reason. The enzyme Pfu FEN-1 gives no detectable cleavage in the absence of the upstream oligonucleotide or even in the presence of an upstream oligonucleotide that fails to invade the probe-target complex. This indicates that the Pfu FEN-1 endonuclease is a suitable enzyme for use in the methods of the present invention.

Other structure-specific nucleases may be suitable as a well. As discussed in the first example, some 5' nucleases can be used in conditions that significantly reduce this primer-independent cleavage. For example, it has been shown that when the 5' nuclease of DNAPTaq is used to cleave hairpins the primer-independent cleavage is markedly reduced by the inclusion of a monovalent salt in the reaction (Lyamichev, et al., [1993], supra).

III. Effect of ARRESTOR Molecules on Signal and Background in Sequential Invasive Cleavage Reactions.

As described above, the concentration of the probe that is cleaved can be used to increase the rate of signal accumulation, with higher concentrations of probe yielding higher final signal. However, the presence of large amounts of residual uncleaved probe can present problems for subsequent use of the cleaved products for detection or for further amplification. If the subsequent step is a simple detection (e.g., by gel resolution), the excess uncut material may cause background by streaking or scattering of signal, or by overwhelming a detector (e.g., over-exposing a film in the case of radioactivity, or exceeding the quantitative detection limits of a fluorescence imager). This can be overcome by partitioning the product from the uncut probe. In more complex detection methods, the cleaved product may be intended to interact with another entity to indicate cleavage. As noted above, the cleaved product can be used in any reaction that makes use of oligonucleotides, such as hybridization, primer extension, ligation, or the direction of invasive cleavage. In each of these cases, the fate of the residual uncut probe should be considered in the design of the reaction. In a primer extension reaction, the uncut probe can hybridize to a template for extension. If cleavage is required to reveal the correct 3' end for extension, the hybridized uncut probe will not be extended. It may, however, compete with the cleaved product for the template. If the template is in excess of the combination of cleaved and uncleaved probe, then both of the latter should be able to find a copy of template for binding. If, however, the template is limiting, any competition may reduce the portion of the cleaved probe that can find successfully bind to the available template. If a vast excess of probe was used to drive the initial reaction, the remainder may also be in vast excess over the cleavage product, and thus may provide a very effective competitor, thereby reducing the amount of the final reaction (e.g., extension) product for ultimate detection.

The participation of the uncut probe material in a secondary reaction can also contribute to background in these reactions. While the presentation of a cleaved probe for a subsequent reaction may represent an ideal substrate for the enzyme to be used in the next step, some enzymes may also be able to act, albeit inefficiently, on the uncut probe as well. It was shown during the development of the present invention that transcription can be promoted from a nicked promoter even when one side of the nick has additional unpaired nucleotides. Similarly, when the subsequent reaction is to be an invasive cleavage, the uncleaved probe may bind to the elements intended to form the second cleavage structure with the cleaved probe. In experiments conducted during the development of the present invention, it was found that some of the 5' nucleases described herein can catalyze some measure of cleavage of defective structures.

Even at a low level, this aberrant cleavage can be misinterpreted as positive target-specific cleavage signal.

With these negative effects of the surfeit of uncut probe considered, there is clearly a need for some method of preventing these interactions. As noted above, it is possible to partition the cleaved product from the uncut probe after the primary reaction by traditional methods. However, these methods are often time consuming, may be expensive (e.g., disposable columns, gels, etc.), and may increase the risk for sample mishandling or contamination. It is far preferable to configure the sequential reactions such that the original sample need not be removed to a new vessel for subsequent reaction.

The present invention provides a method for reducing interactions between the primary probe and other reactants. This method provides a means of specifically diverting the uncleaved probes from participation in the subsequent reactions. The diversion is accomplished by the inclusion in the next reaction step an agent designed to specifically interact with the uncleaved primary probe. While the primary probe in an invasive cleavage reaction is discussed for reasons of convenience, it is contemplated that the ARRESTOR molecules may be used at any reaction step within a chain of invasive cleavage steps, as needed or desired for the design of an assay. It is not intended that the ARRESTOR molecules of the present invention be limited to any particular step.

The method of diverting the residual uncut probes from a primary reaction makes use of agents that can be specifically designed or selected to bind to the uncleaved probe molecules with greater affinity than to the cleaved probes, thereby allowing the cleaved probe species to effectively compete for the elements of the subsequent reaction, even when the uncut probe is present in vast excess. These agents have been termed "ARRESTOR molecules," due to their function of stopping or arresting the primary probe from participation in the later reaction. In various Examples below, an oligonucleotide is provided as an ARRESTOR molecule in an invasive cleavage assay. It can be appreciated that any molecule or chemical that can discriminate between the full-length uncut probe and the cleaved probe, and that can bind or otherwise disable the uncleaved probe preferentially may be configured to act as ARRESTOR molecules within the meaning of the present invention. For example, antibodies can be derived with such specificity, as can the "aptamers" that can be selected through multiple steps of in vitro amplification (e.g., "SELEX," U.S. Pat. Nos. 5,270, 163 and 5,567,588; herein incorporated by reference) and specific rounds of capture or other selection means.

In one embodiment, the ARRESTOR molecule is an oligonucleotide. In another embodiment the ARRESTOR oligonucleotides is a composite oligonucleotide, comprising two or more short oligonucleotides that are not covalently linked, but that bind cooperatively and are stabilized by co-axial stacking. In a preferred embodiment, the oligonucleotide is modified to reduce interactions with the cleavage agents of the present invention. When an oligonucleotide is used as an ARRESTOR oligonucleotide, it is intended that it not participate in the subsequent reactive step. The binding of the ARRESTOR oligonucleotide to the primary probe may, either with the participation of the secondary target, or without such participation, create a bifurcated structure that is a substrate for cleavage by the 5' nucleases used in some embodiments of the methods of the present invention. Formation of such structures would lead to some level of unintended cleavage that could contribute to background, reduce specific signal or compete for the enzyme. It is preferable to provide ARRESTOR oligonucleotides that will not create such cleavage structures. One method of doing this is to add to the ARRESTOR oligonucleotides such modifications as have been found to reduce the activity of INVADER oligonucleotides, as the INVADER oligonucleotides occupy a similar position within a cleavage structure (i.e., the 3' end of the INVADER oligonucleotide positions the site of cleavage of an unpaired 5' arm). Modification of the 3' end of the INVADER oligonucleotides was examined for the effects on cleavage in the Example section below; a number of the modifications tested were found to be significantly debilitating to the function of the INVADER oligonucleotide. Other modifications not described herein may be easily characterized by performing such a test using the cleavage enzyme to be used in the reaction for which the ARRESTOR oligonucleotide is intended.

In a preferred embodiment, the backbone of an ARRESTOR oligonucleotide is modified. This may be done to increase the resistance to degradation by nucleases or temperature, or to provide duplex structure that is a less favorable substrate for the enzyme to be used (e.g., A-form duplex vs. B-form duplex). In particularly preferred embodiment, the backbone-modified oligonucleotide further comprises a 3' terminal modification. In a preferred embodiment, the modifications comprise 2' O-methyl substitution of the nucleic acid backbone, while in a particularly preferred embodiment, the 2' O-methyl modified oligonucleotide further comprises a 3' terminal amine group.

The purpose of the ARRESTOR oligonucleotide is to allow the minority population of cleaved probe to effectively compete with the uncleaved probe for binding whatever elements are to be used in the next step. While an ARRESTOR oligonucleotide that can discriminate between the two probe species absolutely (i.e., binding only to uncut and never to cut) may be of the greatest benefit in some embodiments, it is envisioned that in many applications, including the sequential INVADER assays described herein, the ARRESTOR oligonucleotide of the present invention may perform the intended function with only partial discrimination. When the ARRESTOR oligonucleotide has some interaction with the cleaved probe, it may prevent detection of some portion of these cleavage products, thereby reducing the absolute level of signal generated from a given amount of target material. If this same ARRESTOR oligonucleotide has the simultaneous effect of reducing the background of the reaction (i.e., from non-target specific cleavage) by a factor that is greater than the factor of reduction in the specific signal, then the significance of the signal (i.e., the ratio of signal to background), is increased, even with the lower amount of absolute signal. Any potential ARRESTOR molecule design may be tested in a simple fashion by comparing the levels of background and specific signals from reactions that lack ARRESTOR molecules to the levels of background and specific signal from similar reactions that include ARRESTOR oligonucleotides. What constitutes an acceptable level of tradeoff of absolute signal for specificity will vary for different applications (e.g., target levels, readout sensitivity, etc.), and can be determined by any individual user using the methods of the present invention. In some embodiments, an ARRESTOR oligonucleotide may be used to stop signal generation from one or more particular target nucleic acids (e.g., an internal standard, or one that is present in higher abundance) so that incubation of the reaction mixture can be continued such that additional signal can accumulate from one or more other target nucleic acids in the same reaction vessel.

IV. Improved Enzymes for Use in INVADER Oligonucleotide-Directed Cleavage Reactions Comprising RNA Targets;

A cleavage structure is defined herein as a structure that is formed by the interaction of a probe oligonucleotide and a target nucleic acid to form a duplex, the resulting structure being cleavable by a cleavage agent, including but not limited to an enzyme. The cleavage structure is further defined as a substrate for specific cleavage by the cleavage means in contrast to a nucleic acid molecule that is a substrate for nonspecific cleavage by agents such as phosphodiesterases. In considering improvements to enzymatic cleavage agents, one may consider the action of said enzymes on any structures that fall within the definition of a cleavage structure. Specific cleavage at any site within such a structure is contemplated.

Improvements in an enzyme may be an increased or decreased rate of cleavage of one or more types of structures. Improvements may also result in more or fewer sites of cleavage on one or more of said cleavage structures. In developing a library of new structure-specific nucleases for use in nucleic acid cleavage assays, improvements may have many different embodiments, each related to the specific substrate structure used in a particular assay.

As an example, one embodiment of the INVADER oligonucleotide-directed cleavage assay of the present invention may be considered. In the INVADER oligonucleotide-directed cleavage assay, the accumulation of cleaved material is influenced by several features of the enzyme behavior. Not surprisingly, the turnover rate, or the number of structures that can be cleaved by a single enzyme molecule in a set amount of time, is very important in determining the amount of material processed during the course of an assay reaction. If an enzyme takes a long time to recognize a substrate (e.g., if it is presented with a less-than-optimal structure), or if it takes a long time to execute cleavage, the rate of product accumulation is lower than if these steps proceeded quickly. If these steps are quick, yet the enzyme "holds on" to the cleaved structure, and does not immediately proceed to another uncut structure, the rate will be negatively affected.

Enzyme turnover is not the only way in which enzyme behavior can negatively affect the rate of accumulation of product. When the means used to visualize or measure product is specific for a precisely defined product, products that deviate from that definition may escape detection, and thus the rate of product accumulation may appear to be lower than it is. For example, if one had a sensitive detector for trinucleotides that could not see di- or tetranucleotides, or any sized oligonucleotide other that 3 residues, in the INVADER-directed cleavage assay of the present invention any errant cleavage would reduce the detectable signal proportionally. It can be seen from the cleavage data presented here that, while there is usually one site within a probe that is favored for cleavage, there are often products that arise from cleavage one or more nucleotides away from the primary cleavage site. These are products that are target-dependent, and are thus not non-specific background. Nevertheless, if a subsequent visualization system can detect only the primary product, these represent a loss of signal. One example of such a selective visualization system is the charge reversal readout presented herein, in which the balance of positive and negative charges determines the behavior of the products. In such a system the presence of an extra nucleotide or the absence of an expected nucleotide can exclude a legitimate cleavage product from ultimate detection by leaving that product with the wrong balance of charge. It can be easily seen that any assay that can sensitively distinguish the nucleotide content of an oligonucleotide, such as standard stringent hybridization, suffers in sensitivity when some fraction of the legitimate product is not eligible for successful detection by that assay.

These discussions suggest two highly desirable traits in any enzyme to be used in the method of the present invention. First, the more rapidly the enzyme executes an entire cleavage reaction, including recognition, cleavage and release, the more signal it may potentially created in the INVADER oligonucleotide-directed cleavage assay. Second, the more successful an enzyme is at focusing on a single cleavage site within a structure, the more of the cleavage product can be successfully detected in a selective read-out.

The rationale cited above for making improvements in enzymes to be used in the INVADER oligonucleotide-directed cleavage assay are meant to serve as an example of one direction in which improvements might be sought, but not as a limit on either the nature or the applications of improved enzyme activities. As another direction of activity change that would be appropriately considered improvement, the DNAP-associated 5' nucleases may be used as an example. In creating some of the polymerase-deficient 5' nucleases described herein it was found that the those that were created by deletion of substantial portions of the polymerase domain, assumed activities that were weak or absent in the parent proteins. These activities included the ability to cleave non-forked structures, a greatly enhanced ability to exonucleolytically remove nucleotides from the 5' ends of duplexed strands, and a nascent ability to cleave circular molecules without benefit of a free 5' end.

In addition to the 5' nucleases derived from DNA polymerases, the present invention also contemplates the use of structure-specific nucleases that are not derived from DNA polymerases. For example, a class of eukaryotic and archaebacterial endonucleases have been identified which have a similar substrate specificity to 5' nucleases of Pol I-type DNA polymerases. These are the FEN1 (Flap EndoNuclease), RAD2, and XPG (Xeroderma Pigmentosa-complementation group G) proteins. These proteins are involved in DNA repair, and have been shown to favor the cleavage of structures that resemble a 5' arm that has been displaced by an extending primer during polymerization. Similar DNA repair enzymes have been isolated from single cell and higher eukaryotes and from archaea, and there are related DNA repair proteins in eubacteria. Similar 5' nucleases have also been associated with bacteriophage such as T5 and T7.

Recently, the 3-dimensional structures of DNAPTaq and T5 phage 5'-exonuclease were determined by X-ray diffraction (Kim et al., Nature 376:612 [1995]; and Ceska et al., Nature 382:90 [1995]). The two enzymes have very similar 3-dimensional structures despite limited amino acid sequence similarity. The most striking feature of the T5 5'-exonuclease structure is the existence of a triangular hole formed by the active site of the protein and two alpha helices. This same region of DNAPTaq is disordered in the crystal structure, indicating that this region is flexible, and thus is not shown in the published 3-dimensional structure. However, the 5' nuclease domain of DNAPTaq is likely to have the same structure, based its overall 3-dimensional similarity to T5 5'-exonuclease, and that the amino acids in the disordered region of the DNAPTaq protein are those associated with alpha helix formation. The existence of such a hole or groove in the 5' nuclease domain of DNAPTaq was predicted based on its substrate specificity (Lyamichev et al., supra).

It has been suggested that the 5' arm of a cleavage structure must thread through the helical arch described above to position said structure correctly for cleavage (Ceska et al., supra). One of the modifications of 5' nucleases described herein opened up the helical arch portion of the protein to allow improved cleavage of structures that cut poorly or not at all (e.g., structures on circular DNA targets that would preclude such threading of a 5' arm). The gene construct that was chosen as a model to test this approach was the one called CLEAVASE BN, which was derived from DNAPTaq but does not contain the polymerase domain. It comprises the entire 5' nuclease domain of DNAP Taq, and thus should be very close in structure to the T5 5' exonuclease. This 5' nuclease was chosen to demonstrate the principle of such a physical modification on proteins of this type. The arch-opening modification of the present invention is not intended to be limited to the 5' nuclease domains of DNA polymerases, and is contemplated for use on any structure-specific nuclease that includes such an aperture as a limitation on cleavage activity. The present invention contemplates the insertion of a thrombin cleavage site into the helical arch of DNAPs derived from the genus *Thermus* as well as 5' nucleases derived from DNAPs derived from the genus *Thermus*. The specific example shown herein using the CLEAVASE BN/thrombin nuclease merely illustrates the concept of opening the helical arch located within a nuclease domain. As the amino acid sequence of DNAPs derived from the genus *Thermus* are highly conserved, the teachings of the present invention enable the insertion of a thrombin site into the helical arch present in these DNAPs and 5' nucleases derived from these DNAPs.

The opening of the helical arch was accomplished by insertion of a protease site in the arch. This allowed post-translational digestion of the expressed protein with the appropriate protease to open the arch at its apex. Proteases of this type recognize short stretches of specific amino acid sequence. Such proteases include thrombin and factor Xa. Cleavage of a protein with such a protease depends on both the presence of that site in the amino acid sequence of the protein and the accessibility of that site on the folded intact protein. Even with a crystal structure it can be difficult to predict the susceptibility of any particular region of a protein to protease cleavage. Absent a crystal structure it must be determined empirically.

In selecting a protease for a site-specific cleavage of a protein that has been modified to contain a protease cleavage site, a first step is to test the unmodified protein for cleavage at alternative sites. For example, DNAPTaq and CLEAVASE BN nuclease were both incubated under protease cleavage conditions with factor Xa and thrombin proteases. Both nuclease proteins were cut with factor Xa within the 5' nuclease domain, but neither nuclease was digested with large amounts of thrombin. Thus, thrombin was chosen for initial tests on opening the arch of the CLEAVASE BN enzyme.

In the protease/CLEAVASE modifications described herein the factor Xa protease cleaved strongly in an unacceptable position in the unmodified nuclease protein, in a region likely to compromise the activity of the end product. Other unmodified nucleases contemplated herein may not be sensitive to the factor Xa, but may be sensitive to thrombin or other such proteases. Alternatively, they may be sensitive to these or other such proteases at sites that are immaterial to the function of the nuclease sought to be modified. In approaching any protein for modification by addition of a protease cleavage site, the unmodified protein should be tested with the proteases under consideration to determine which proteases give acceptable levels of cleavage in other regions.

Working with the cloned segment of DNAPTaq from which the CLEAVASE BN protein is expressed, nucleotides encoding a thrombin cleavage site were introduced in-frame near the sequence encoding amino acid 90 of the nuclease gene. This position was determined to be at or near the apex of the helical arch by reference to both the 3-dimensional structure of DNAPTaq, and the structure of T5 5' exonuclease. The encoded amino acid sequence, LVPRGS, was inserted into the apex of the helical arch by site-directed mutagenesis of the nuclease gene. The proline (P) in the thrombin cleavage site was positioned to replace a proline normally in this position in CLEAVASE BN because proline is an alpha helix-breaking amino acid, and may be important for the 3-dimensional structure of this arch. This construct was expressed, purified and then digested with thrombin. The digested enzyme was tested for its ability to cleave a target nucleic acid, bacteriophage M13 genomic DNA, that does not provide free 5' ends to facilitate cleavage by the threading model.

While the helical arch in this nuclease was opened by protease cleavage, it is contemplated that a number of other techniques could be used to achieve the same end. For example, the nucleotide sequence could be rearranged such that, upon expression, the resulting protein would be configured so that the top of the helical arch (amino acid 90) would be at the amino terminus of the protein, the natural carboxyl and amino termini of the protein sequence would be joined, and the new carboxyl terminus would lie at natural amino acid 89. This approach has the benefit that no foreign sequences are introduced and the enzyme is a single amino acid chain, and thus may be more stable that the cleaved 5' nuclease. In the crystal structure of DNAPTaq, the amino and carboxyl termini of the 5'-exonuclease domain lie in close proximity to each other, which suggests that the ends may be directly joined without the use of a flexible linker peptide sequence as is sometimes necessary. Such a rearrangement of the gene, with subsequent cloning and expression could be accomplished by standard PCR recombination and cloning techniques known to those skilled in the art.

The INVADER invasive cleavage reaction has been shown to be useful in the detection of RNA target strands (See e.g., U.S. Pat. No. 6,001,567, incorporated herein by reference in its entirety). As with the INVADER assay for the detection of DNA (Lyamichev et al., Nat. Biotechnol., 17:292 [1999]), the reactions may be run under conditions that permit the cleavage of many copies of a probe for each copy of the target RNA present in the reaction. In one embodiment, the reaction may be performed at a temperature close to the melting temperature ($T_m$) of the probe that is cleaved, such that the cleaved and uncleaved probes readily cycle on and off the target strand without temperature cycling. Each time a full-length probe binds to the target in the presence of the INVADER oligonucleotide, it may be cleaved by a 5' nuclease enzyme, resulting in an accumulation of cleavage product. The accumulation is highly specific for the sequence being detected, and may be configured to be proportional to both time and target concentration of the reaction. In another embodiment, the temperature of the reaction may be shifted (i.e., it may be raised to a temperature that will cause the probe to dissociate) then lowered to a temperature at which a new copy of the probe hybridizes to the target and is cleaved by the enzyme. In a further embodiment, the process of raising and lowering the temperature is repeated many times, or cycled, as it is in PCR (Mullis and Faloona, Methods in Enzymology, 155:335 [1987], Saiki et al., Science 230:1350 [1985]).

As noted above, 5' nucleases of Pol A type DNA polymerases are preferred for cleavage of an invasive cleavage structure that comprises an RNA target strand. The present invention provides enzymes having improved performance in detection assays based on the cleavage of a structure comprising RNA. In particular, the altered polymerases of the present invention exhibit improved performance in detection assays based on the cleavage of a DNA member of an invasive cleavage structure that comprises an RNA target strand.

Figure 5:
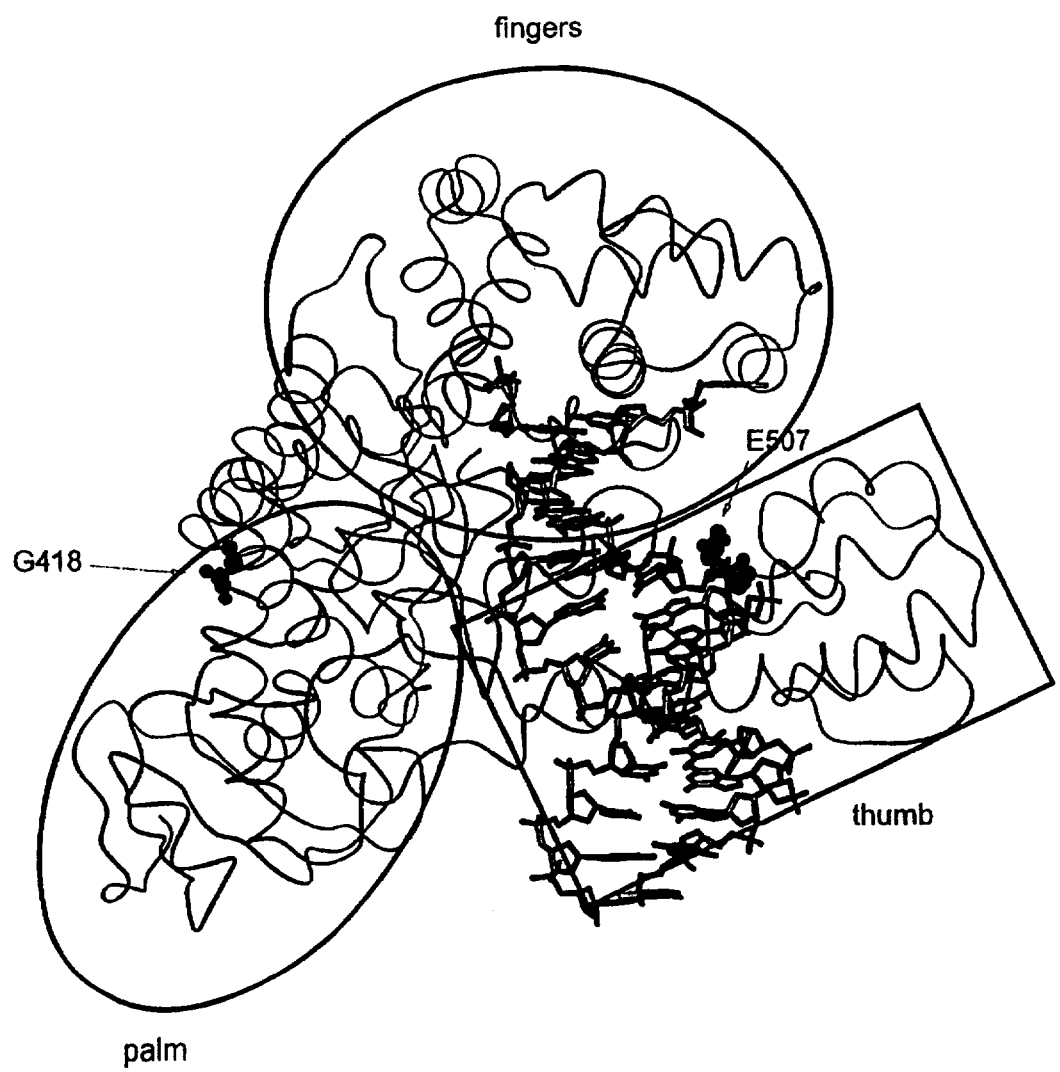
FIG. 5 shows a diagram of the X-ray structure of a ternary complex of Klentaq1 with primer/template DNA in the polymerizing mode determined by Li et al. (Li et al., Protein Sci., 7:1116 [1998]). Without intending to represent precise borders between features of the physical form, the portions referred to in the text as the "fingers", "thumb" and "palm" regions are loosely indicated by the circle, rectangle, and oval, respectively.
Figure 6:
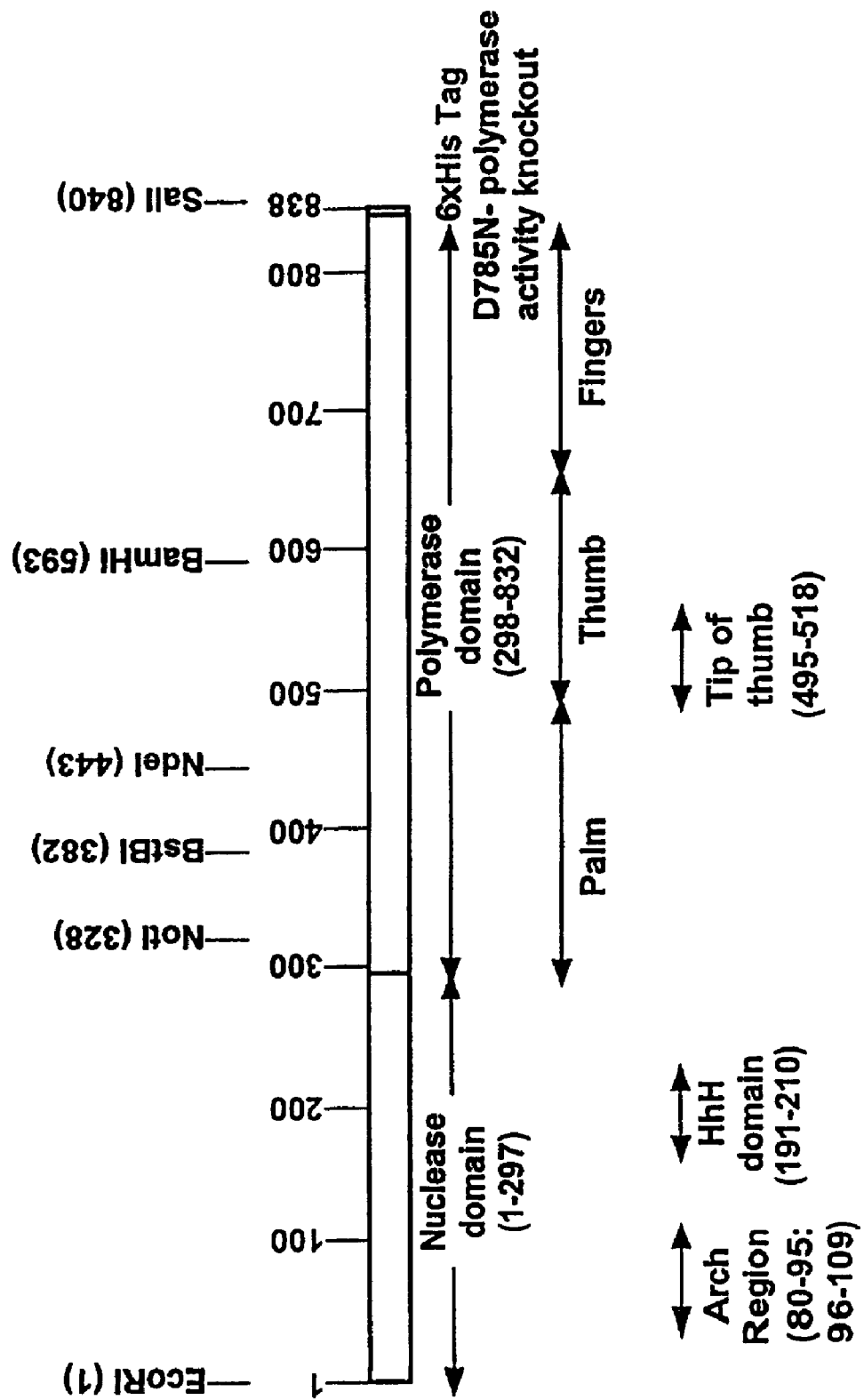
FIG. 6 shows a schematic diagram of the DNA polymerase gene from *Thermus aquaticus*. Restriction sites used in these studies are indicated above. The approximate regions encoding various structural or functional domains of the protein are indicated by double-headed arrows, below.

The 5' nucleases of the present invention may be derived from Pol A type DNA polymerases. The terminology used in describing the alterations made in this class of 5' nucleases relates to the descriptions of DNA polymerase structures known in the art. The Klenow fragment of the Pol A polymerase from E. coli (the C-terminal two thirds, which has the DNA synthesizing activity but lacks the 5' nuclease activity) has been described as having a physical form resembling a right hand, having an open region called the "palm", and a cleft that holds the primer/template duplex defined on one side by a "fingers" domain and on the other by a "thumb" domain (Joyce and Steitz, Trends in Biochemical Science 12:288 [1987]). This is shown schematically in FIG. 5. Because this physical form has proved to be common to all Pol A DNA polymerases and to a number of additional template-dependent polymerizing enzymes such as reverse transcriptases, the hand terminology has become known in the art, and the sites of activity in these enzymes are often described by reference to their position on the hand. For reference, and not intended as a limitation on the present invention, the palm is created from roughly the first 200 amino acids of the polymerase domain, the thumb from the middle 140, and the fingers by the next 160, with the base of the cleft formed from the remaining regions (FIGS. 6). Although some enzymes may deviate from these structural descriptions, the equivalent domains and sequences corresponding to such domains may be identified by sequence homology to known enzyme sequences, by comparison of enzyme crystal structures, and other like methods.

In creating the improved enzymes of the present invention, several approaches have been taken, although the present invention in not limited to any particular approach. First two DNA polymerases, Taq and Tth, that have different rates of DNA strand cleavage activity on RNA targets were compared. To identify domains related to the differences in activity, a series of chimerical constructs was created and the activities were measured. This process identified two regions of the Tth polymerase that could, if transferred into the Taq polymerase, confer on the TaqPol an RNA-dependent cleavage activity equivalent to that of the native Tth protein. Once these regions were identified, the particular amino acids involved in the activity were examined. Since the two proteins are about 87 percent identical in amino acid sequence overall, the identified regions had only a small number of amino acid differences. By altering these amino acids singly and in combinations, a pair of amino acids were identified in TthPol that, if introduced into the TaqPol protein, increased the rate of cleavage up to that of the native TthPol.

These data demonstrate two important aspects of the present invention. First, specific amino acids can be changed to confer TthPol-like RNA-dependent cleavage activity on a polymerase having a lesser activity. More broadly, however, these results provide regions of these polymerases that are involved in the recognition of the RNA-containing cleavage structure. Identification of these important regions, combined with published information on the relationships of other amino acids to the various functions of these DNA polymerases and computer-assisted molecular modeling during the development of the present invention have allowed a rational design approach to create additional improved 5' nucleases. The information also allowed a focused random mutagenesis approach coupled with a rapid screening procedure to quickly create and identify enzymes having improved properties. Using these methods of the present invention, a wide array of improved polymerases are provided.

The methods used in creating and selecting the improved 5' nucleases of the present invention are described in detail below and in the experimental examples. A general procedure for screening and characterizing the cleavage activity of any 5' nuclease is included in the experimental examples. The methods discussions are divided into the following sections: I) Creation and selection of chimerical constructs; II) Site-specific mutagenesis based on information from chimerical constructs; III) Site-specific mutagenesis based on molecular modeling and published physical studies; and IV) focused random mutagenesis. Additional chimerical constructs not included in this discussion are described in the Experimental Examples.

1) Creation and Selection of Chimerical Constructs

The PolA-type DNA polymerases, including but not limited to DNA polymerase enzymes from Thermus species, comprise two distinctive domains, the 5' nuclease and the polymerase domains, shown schematically in FIG. 6. The polymerase domains reside in the C-terminal two-thirds of the proteins and are responsible for both DNA-dependent and RNA-dependent DNA polymerase activities. The N-terminal one-third portions contain the 5' nuclease domains. In the genus Thermus Pol A polymerase, the palm region consists of, roughly, amino acids 300–500, the thumb region includes amino acids 500–650, while the fingers region is formed by the remaining amino acids from 650 to 830 (FIG. 6).

The derivatives, Taq DN RX HT and Tth DN RX HT, of Taq and TthPol used in many of the experiments of the present invention, and described herein, are modified to reduce synthetic activity and to facilitate chimera construction, but have 5' nuclease activity essentially identical to unmodified TaqPol and TthPol. Unless otherwise specified, the TaqPol and TthPol enzymes of the following discussion refer to the DN RX HT derivative.

Figure 10:
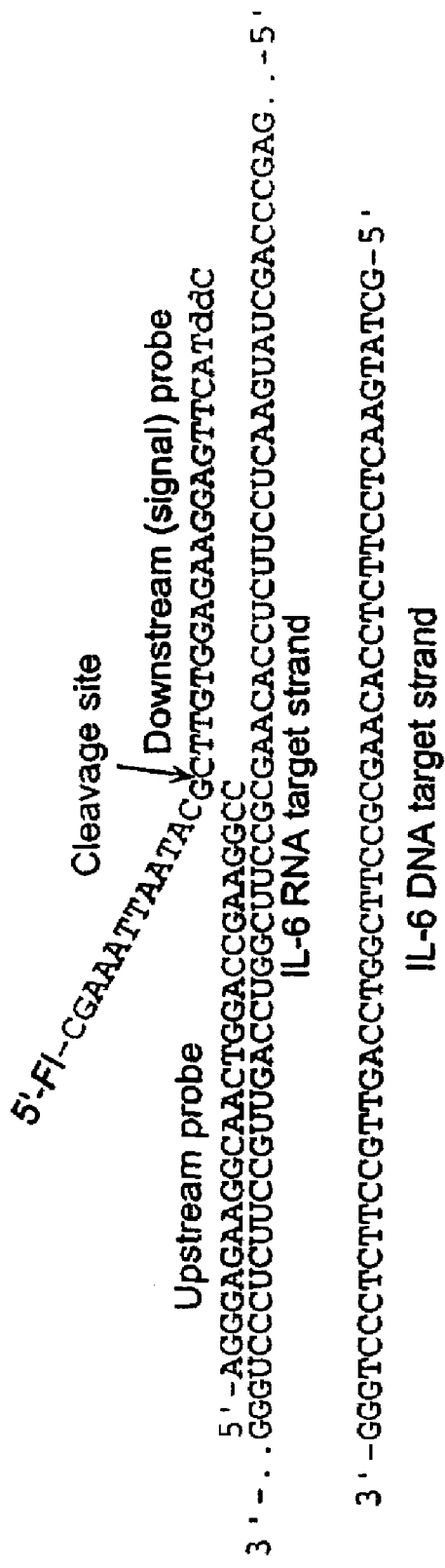
FIG. 10 shows the sequences and proposed structures of substrates for the invasive signal amplification reaction with human IL-6 RNA target strand (SEQ ID NO:160) and upstream probe (SEQ ID NO:161). The cleavage site of the downstream probe (SEQ ID NO:162) is indicated by an arrow. Sequence of the IL-6 DNA target strand (SEQ ID NO:163) is shown below.
Figure 11:
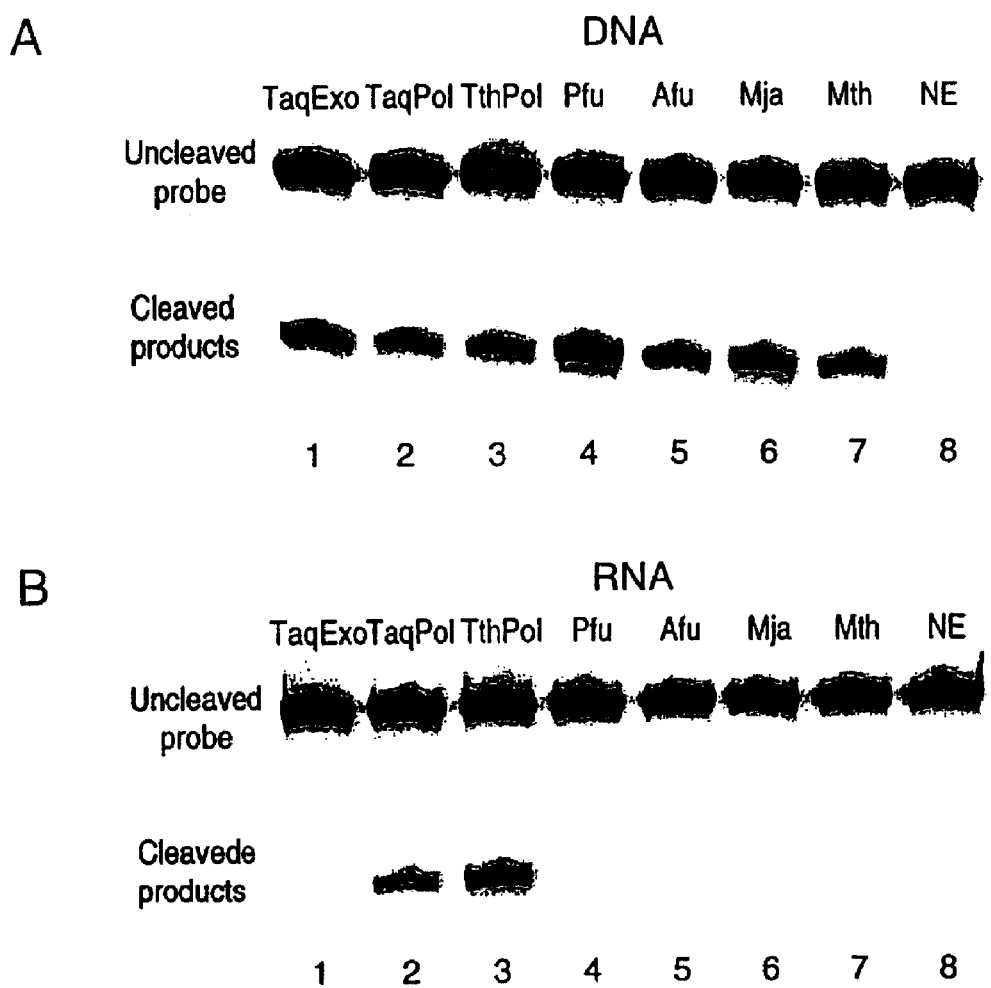
FIG. 11 shows the image generated by a fluorescence imager showing the products of invasive cleavage assays using the indicated enzymes, and the IL-6 substrate of FIG. 10 having either a DNA target strand (A) or an RNA target strand (B).

TthPol has a 4-fold higher cleavage rate with the IL-6 RNA template (shown in FIG. 10) than TaqPol (shown in FIGS. 11 and 12), although the Taq and TthPols show similarities of cleavage in DNA target structures (FIG. 10). Since the amino acid sequences of TaqPol and TthPol (FIGS. 8 and 9) share about 87% identity and greater than 92% similarity, the high degree of homology between the enzymes allowed creation of a series of chimeric enzymes between TthPol and TaqPol. The activity of the chimeric enzymes was used as a parameter to identify the region(s) of these proteins affecting RNA dependent 5' nuclease activity.

Figure 7:
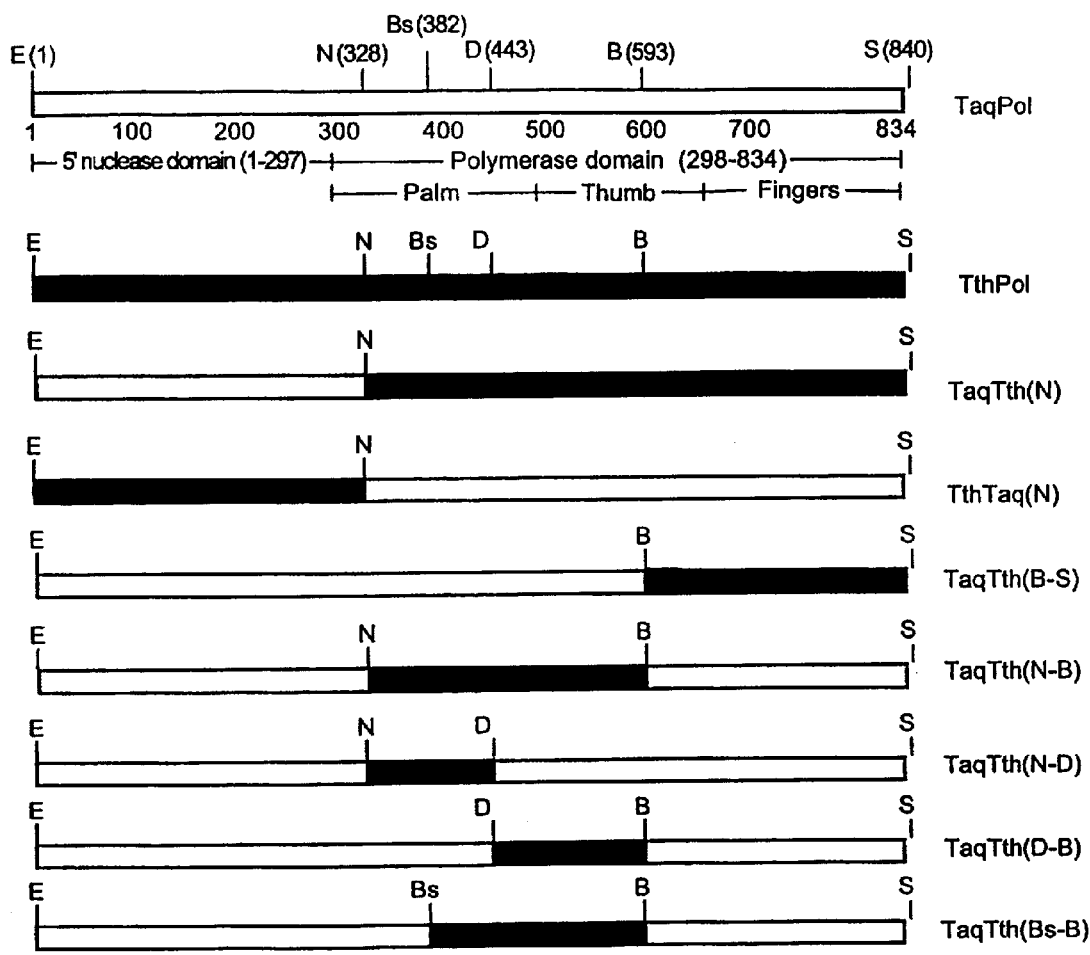
FIG. 7 shows a schematic diagram of the chimeric constructs comprising portions of the TaqPol gene and the TthPol gene. Open and shaded boxes denote TaqPol and TthPol sequences, respectively. The numbers correspond to the amino acid sequence of TaqPol. The 5' nuclease and polymerase domains of TaqPol and the palm, thumb, and fingers regions of the polymerase domain are indicated. The abbreviations for the restrictions sites used for recombination are as follows: E, EcoRI; N, NotI; Bs, BstBI; D, NdeI; B, BamHI; and S, SalI.
Figure 19:
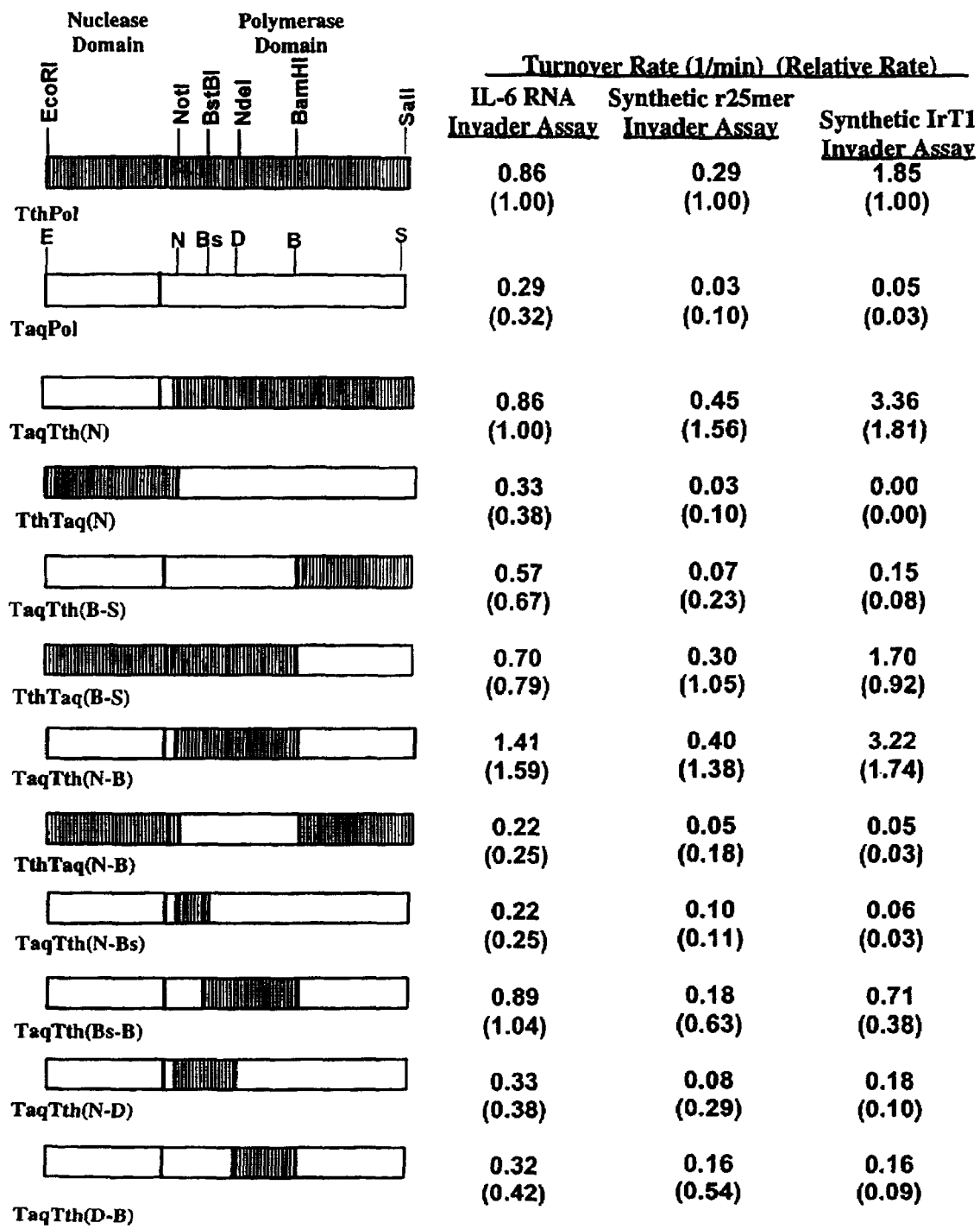
FIG. 19 shows schematic diagrams of chimeric constructs comprising portions of the TaqPol gene and the TthPol gene. Open and shaded boxes denote TaqPol and TthPol sequences, respectively. The chimeras also include the DN, RX, and HT modifications. A table compares the cleavage activity of each protein on the indicated cleavage substrates.

The chimeric constructs between TthPol and TaqPol genes shown schematically in FIGS. 7 and 19 were created by swapping DNA fragments defined by the restriction endonuclease sites, EcoRI and BamHI, common for both genes, the cloning vector site SalI and the new sites, NotI, BstBI and NdeI, created at the homologous positions of both genes by site directed mutagenesis. The restriction enzymes have been abbreviated as follows: EcoRI is E; NotI is N; BstBI is Bs; NdeI is D, BamHI is B, and SalI is S.

Figure 12:
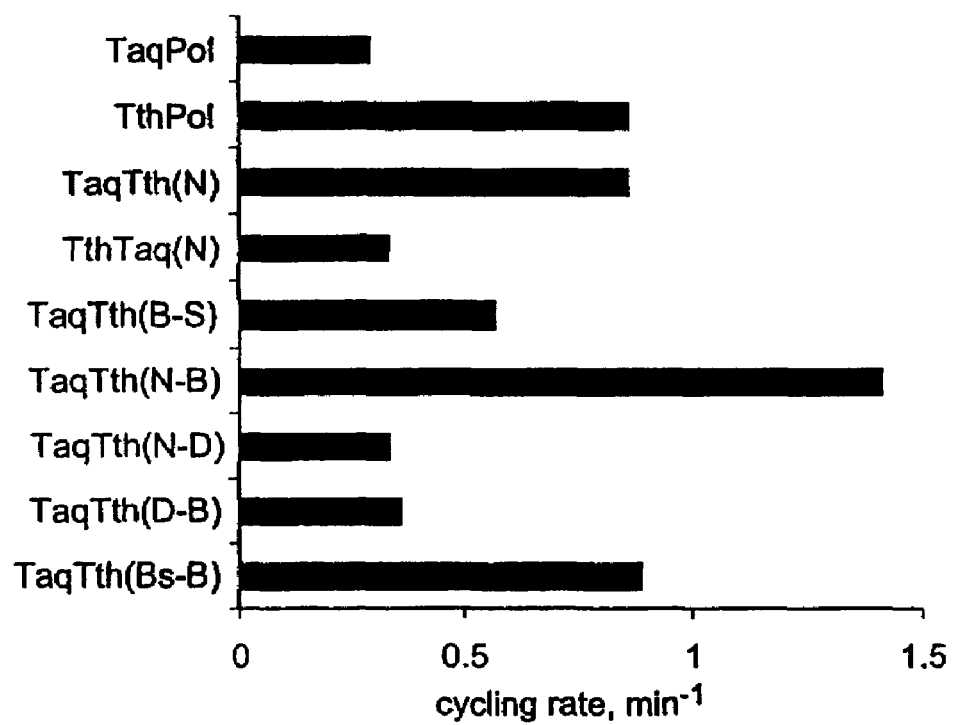
FIG. 12 compares the cycling cleavage activities of Taq DN RX HT, Tth DN RX HT, and Taq-Tth chimerical enzymes with IL-6 substrate having an RNA target strand.

The activity of each chimeric enzyme was evaluated using the invasive signal amplification assay with the IL-6 RNA target (FIG. 10), and the cycling cleavage rates shown in FIG. 12 were determined as described in the Experimental Examples. Comparison of the cleavage rates of the first two chimeras, TaqTth(N) and TthTaq(N), created by swapping the polymerase and 5' nuclease domains at the NotI site (FIG. 7), shows that TaqTth(N) has the same activity as TthPol, whereas its counterpart TthTaq(N) retains the activity of TaqPol (FIG. 12). This result indicates that the higher cleavage rate of TthPol is associated with its polymerase domain and suggests an important role of the polymerase domain in the 5' nuclease activity.

The next step was to identify a minimal region of TthPol polymerase that would give rise to the TthPol-like RNA dependent 5' nuclease activity when substituted for the corresponding region of the TaqPol sequence. To this end, the TaqTth(N) chimera was selected to generate a series of new constructs by replacing its TthPol sequence with homologous regions of TaqPol. First, the N-terminal and C-terminal parts of the TaqPol polymerase domain were substituted for the corresponding regions of TaqTth(N) using the common BamHI site as a breaking point to create TaqTth(N-B) and TaqTth(B-S) chimeras, respectively (FIG. 7). TaqTth(N-B) which has the TthPol sequence between amino acids 328 and 593, is approximately 3 times more active than the TaqTth(B-S) and 40% more active than TthPol (FIG. 12). This result establishes that the NotI-BamHI portion of the TthPol polymerase domain determines superior RNA-dependent 5' nuclease activity of TthPol.

From these data it was determined that a central portion of the TthPol, when used to replace the homologous portion of TaqPol (TaqTth(N-B) construct) could confer superior RNA recognition on the chimerical protein composed primarily of Taq protein. In fact, the cycling rate of this chimerical protein exceeded that of the parent TthPol. Comparison of chimeras that included sub-portions of the activity-improving region of TthPol, approximately 50% of the region in each case (See, TaqTth(N-D) and TaqTth(D-B), FIGS. 7 and 12) showed no significant improvement in RNA dependent activity as compared to the parent TaqPol. This result indicates that aspects of each half of the region are required for this activity. A construct having an only slightly smaller portion of the Tth insert portion (TaqTth(Bs-B)) showed activity that was close to that of the parent TthPol protein, but which was less than that of the TaqTth(N-B) construct.

2) Site-Specific Mutagenesis Based on Information from Chimerical Constructs

Comparison of the TthPol and TaqPol amino acid sequences between the BstBI and BamHI sites reveals only 25 differences (FIG. 13). Among those, there are 12 conservative changes and 13 substitutions resulting in a change in charge. Since the analysis of the chimeric enzymes has suggested that some critical amino acid changes are located in both BstBI-NdeI and NdeI-BamHI regions of TthPol, site directed mutagenesis was used to introduce the TthPol specific amino acids into the BstBI-NdeI and NdeI-BamHI regions of the TaqTth(D-B) and TaqTth (N-D) chimeras, respectively. Six TthPol-specific substitutions were generated in the BstBI-NdeI region of the TaqTth(D-B) by single or double amino acid mutagenesis and only one double mutation, W417L/G418K, was able to restore the TthPol activity with the IL-6 RNA target (See e.g., FIG. 14). Similarly, 12 TthPol specific amino acids were introduced at the homologous positions of the NdeI-BamHI region of the TaqTth(N-D) and only one of them, E507Q, increased the cleavage rate to the TthPol level (See e.g., FIG. 14).

Figure 15:
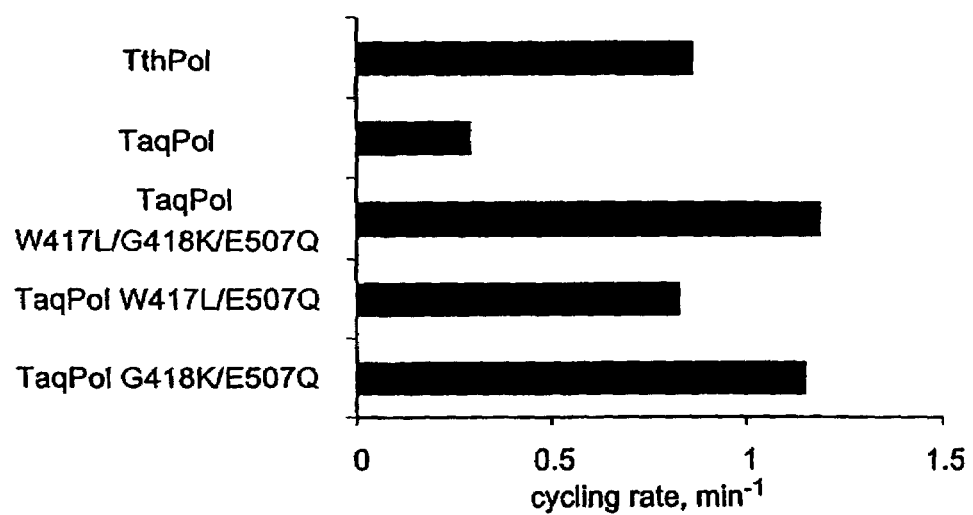
FIG. 15 compares the cycling cleavage activities of Taq DN RX HT, Tth DN RX HT, and Taq DN RX HT having the indicated amino acid modifications, with IL-6 substrate having an RNA target strand.

To confirm that the W417L, G418K and E507Q substitutions are sufficient to increase the TaqPol activity to the TthPol level, TaqPol variants carrying these mutations were created and their cleavage rates with the IL-6 RNA substrate were compared with that of TthPol. FIG. 15 shows that the TaqPol W417L/G418K/E507Q and TaqPol G418K/E507Q mutants have 1.4 times higher activity than TthPol and more than 4 fold higher activity than TaqPol, whereas the TaqPol W417L/E507Q mutant has the same activity as TthPol, which is about 3 fold higher than TaqPol. These results demonstrate that K418 and Q507 of TthPol are important amino acids in defining its superior RNA dependent 5' nuclease activity compared to TaqPol.

Figure 25:
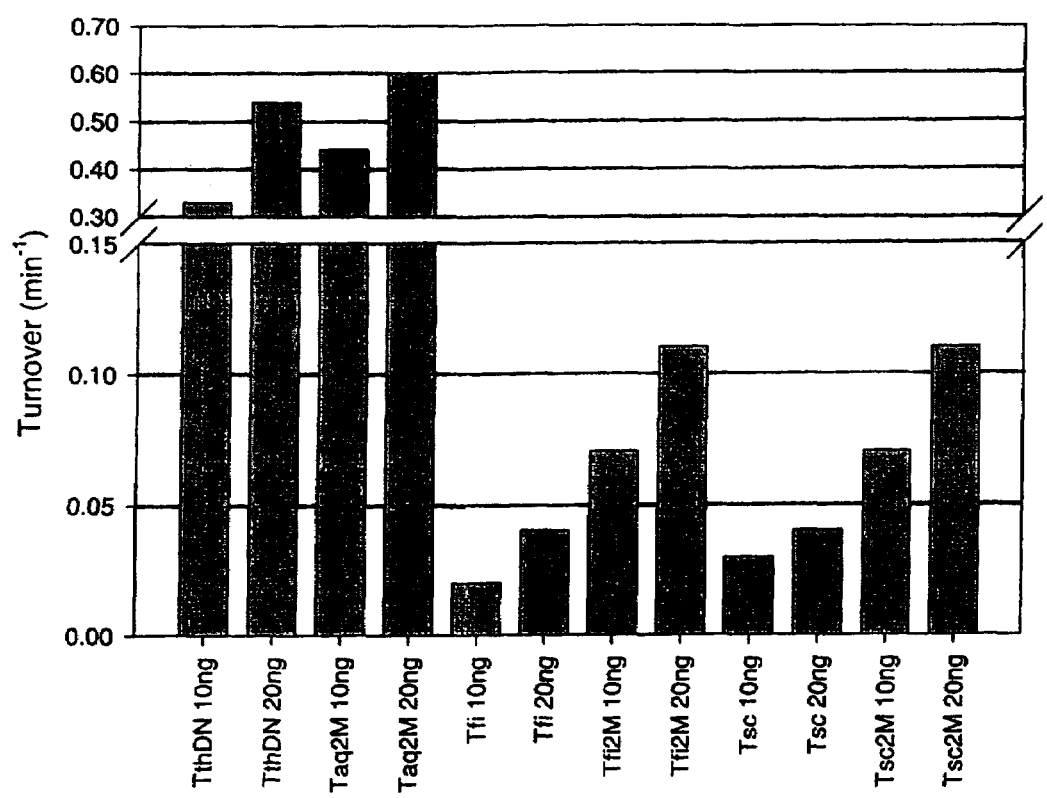
FIG. 25 compares the cycling cleavage activities of Tth DN RX HT, Taq 2M, TfiPol, Tsc Pol, and Tfi and Tsc-derived mutant enzymes.

The ability of these amino acids to improve the RNA dependent 5' nuclease activity of a DNA polymerase was tested by introducing the corresponding mutations into the polymerase A genes of two additional organisms: *Thermus filiformus* and *Thermus scotoductus*. TaqPol showed improved RNA dependent activity when it was modified to contain the W417L and E507Q mutations, which made it more similar at these residues to the corresponding residues of TthPol (K418 and Q507). The TfiPol was modified to have P420K and E507Q, creating TfiDN 2M, while the TscPol was modified to have E416K and E505Q, to create TscDN 2M. The activity of these enzymes for cleaving various DNA and RNA containing structures was determined as described in Example 1, using the IdT2, IrT3, hairpin and X-structures diagrammed in FIGS. 21 and 22, with the results shown in both FIG. 25 and Table 8. Both enzymes have much less RNA-dependent cleavage activity than either the TthPol or the Taq 2M enzymes. However, introduction of the mutations cited above into these polymerases increased the RNA dependent cleavage activity over 2 fold compared to the unmodified enzymes (FIG. 25). These results demonstrate that transferability of improved RNA dependent cleavage activity into a wide range of polymerases using the methods of the present invention.

Figure 17:
FIG. 17 shows a diagram of the X-ray structure of a ternary complex of Klentaq1 with primer/template DNA in the polymerizing mode determined by Li et al. (Li et al., Protein Sci., 7:1116 [1998]). Amino acids G418 and E507 are indicated.

3) Site-Specific Mutagenesis Based on Molecular Modeling and Published Physical Studies The positions of the G418H and E507Q mutations in the crystal structure of a complex of the large fragment of TaqPol (Klentaq1) with a primer/template DNA determined by Li et al. (Li et al., Protein Sci., 7:1116 [1998]) are shown in FIG. 17. The E507Q mutation is located at the tip of the thumb subdomain at a nearest distance of 3.8 Å and 18 Å from the backbone phosphates of the primer and template strands, respectively. The interaction between the thumb and the minor groove of the DNA primer/template was previously suggested by the co-crystal structures of Klenow fragment DNA polymerase I (Breese et al., Science 260:352 [1993]) and TaqPol (Eom et al, Nature 382:278 [1996]). Deletion of a 24 amino acid portion of the tip of the thumb in Klenow fragment, corresponding to amino acids 494–518 of TaqPol, reduces the DNA binding affinity by more than 100-fold (Minnick et al., J. Biol. Chem., 271:24954 [1996]). These observations are consistent with the hypothesis that the thumb region, which includes the E507 residue, is involved in interactions with the upstream substrate duplex.

The W417L and the G418K mutations in the palm region of TaqPol (FIG. 17) are located approximately 25 A from the nearest phosphates of the template and upstream strands, according to the co-crystal structures of TaqPol with duplex DNA bound in the polymerizing mode (Li et al., Protein Sci., 7:1116 [1998], Eom et al., Nature 382:278 [1996]). The same distance was observed between the analogous W513 and P514 amino acids of Klenow fragment and the template strand of DNA bound in the editing mode (Breese et al., Science 260:352 [1993]). Thus, no interactions between TaqPol and the overlapping substrate can be suggested from the available co-crystal studies for this region.

Although an understanding of the mechanism of action of the enzymes is not necessary for the practice of the present invention and the present invention is not limited to any mechanism of action, it is proposed that the amino acids at positions 417 and 418 in the palm region of TaqPol interact with the upstream substrate duplex only when the enzyme functions as a 5' nuclease, but no interaction with these amino acids occurs when TaqPol switches into polymerizing mode. This hypothesis suggests a novel mode of substrate binding by DNA polymerases called here the "5' nuclease mode." Several lines of evidence support this hypothesis. The study of the chimeric enzymes described here clearly separates regions of the polymerase domain involved in the 5' nuclease and polymerase activities. Accordingly, the W417L and G418K mutations, together with the E507Q mutation, affect the 5' nuclease activity of TaqPol on substrates having an RNA target strand (FIG. 15), but have no effect on either RNA-dependent or DNA-dependent DNA polymerase activities (FIG. 16). On the other hand, mutations in the active site of TaqPol, such as R573A, R587A, E615A, R746A, N750A and D785N, which correspond to substitutions in Klenow fragment of E.coli DNA Pol I that affect both polymerase activity and substrate binding affinity in the polymerizing mode (Polesky et al., J. Biol. Chem., 265:14579 [1990], Polesky et al., J. Biol. Chem., 267:8417 [1992], Pandey et al., Eur. J. Biochem., 214:59 [1993]) were shown to have little or no effect on the 5' nuclease activity. Superposition of the polymerase domains of TaqPol (Eom et al., Nature 382:278 [1996]), E.coli Pol I and Bacillus stearothermophilus Pol I (Kiefer et al., Nature 391:304 [1998]) using the programs DALI (Holm and Sander, J. Mol. Biol., 233:123 [1993], Holm and Sander, Science 273:595 [1996]) and Insight II (Molecular Simulation Inc., Naperville, Ill.) shows that the palm region of TaqPol between amino acids 402–451, including W417 and G418, is structurally highly conserved between the three polymerases, although there is no structural similarity between the rest of the palm subdomains. This observation suggests an important role for this region in eubacterial DNA polymerases.

The 5' nuclease and polymerase activities should be precisely synchronized to create a nicked structure rather than a gap or an overhang that could cause a deletion or an insertion during Okazaki fragment processing or DNA repair, if ligase joins the ends inappropriately. According to the previously proposed model (Kaiser et al., J. Biol. Chem., 274:21387 [1999]), the 3' terminal nucleotide of the upstream strand is sequestered by the 5' nuclease domain to prevent its extension, thus halting synthesis. The interaction with the 3' nucleotide apparently activates the 5' nuclease that endonucleolitically removes the displaced 5' arm of the downstream strand. This cleavage occurs by the precise incision at the site defined by the 3' nucleotide, thus creating the nick. This model requires a substantial rearrangement of the substrate-enzyme complex, which may include a translocation of the complex to the 5' nuclease mode to separate the primer/template from the polymerase active site.

It is possible that a relocation of the substrate away from the polymerase active site could be induced by the interaction between the duplex formed between the template and incoming strands and the crevice formed by the finger and thumb subdomains. Such an interaction could force conformational transitions in the thumb that would bring the template/primer duplex into close contact with the W417 and G418 amino acids. Significant flexibility of the thumb has been previously reported that might explain such changes (Beese et al., Science 260:352 [1993], Eom et al., Nature 382:278 [1996], Ollis et al., Nature 313:762 [1985], Kim et al., Nature 376:612 [1995], Korolev et al., Proc. Natl. Acad. Sci., 92:9264 [1995], Li et al, EMBO J., 17:7514 [1998]). Additional conformational changes of the fingers domain that might help to open the crevice, such as the transition from the 'closed' to the 'open' structure described by Li et al. (Li et al., EMBO J., 17:7514 [1998]), are consistent with this model. It may be that the 5' nuclease binding mode was not observed in any of the published co-crystal structures of a DNA Pol I because the majority of the structures were solved for the polymerase domain only, with a template/primer substrate rather than with an overlapping 5' nuclease substrate.

$K_m$ values of 200–300 nM have been determined for TaqPol, TthPol and TaqPol G418K/E507Q for the RNA containing substrate. These values are much higher than the $K_m$ value of <1 nM estimated for TthPol with an all-DNA overlapping substrate suggesting that the RNA template adversely affects substrate binding. The low affinity could be explained by the unfavorable interaction between the enzyme and either the A-form duplex adopted by the substrate with an RNA target, or the ribose 2' hydroxyls of the RNA strand. Between these two factors, the latter seems more likely, since the 5' nucleases of eubacterial DNA polymerases can efficiently cleave substrates with an RNA downstream probe (Lyamichev et al., Science 260:778 [1993]), which would presumably have an A-form. Further, the co-crystal studies suggest that the template/primer duplex partially adopts a conformation close to A-form in its complex with DNA polymerase (Eom et al., Nature 382:278 [1996], Kiefer et al., Nature 391:304 [1998], Li et al., EMBO J., 17:7514 [1998]). The G418K/E507Q mutations increase the $k_{cat}$ of TaqPol more than two fold, but have little effect on $K_m$. Such an effect would be expected if the mutations position the substrate in an orientation more appropriate for cleavage rather than simply increasing the binding constant.

In addition to the mutational analysis described above, another approach to studying specific regions of enzymes, enzyme structure-function relationships, and enzyme-substrate interaction is to investigate the actual, physical structure of the molecule.

With the advances in crystallographic, NMR, and computer and software technology, study of molecular structure has become a viable tool for those interested in the configuration, organization, and dynamics of biomolecules. Molecular modeling has increased the understanding of the nature of the interactions that underlie the structure of proteins and how proteins interact functionally with substrate. Numerous publications describing the structures of various polymerases or polymerase protein portions, HIV reverse transcriptase, and other nucleic acid binding proteins have provided mechanistic insights into protein conformation, changes in conformation, and molecular interactions necessary for function.

As an example, the report by Doublie et al. (Doublie et al., Nature 391:251 [1998]) discloses the crystal structure of T7 DNA polymerase and provides information about which amino acid regions are likely to have an affect on substrate binding, which are required to contact the substrate for polymerization, and which amino acids bind cofactors, such as metal ions. It is noted in this paper and others that many of the polymerases share not only sequence similarity, but structural homology as well. When certain structural domains of different polymerases are superimposed (for example, T7 polymerase, Klenow fragment editing complex, the unliganded Taq DNA polymerase and the Taq Polymerase-DNA complex) conserved motifs are clearly discernable.

Specifically, combining the information from all of these different structural sources and references, a model of the protein interacting with DNA, RNA, or heteroduplex can be made. The model can then be examined to identify amino acids that may be involved in substrate recognition or substrate contact. Changes in amino acids can be made based on these observations, and the effects on the various activities of the 5' nuclease proteins are assessed using screening methods such as those of the present invention, described in the experimental examples.

The domain swapping analysis discussed previously demonstrated that sequences of TthDN that are important in RNA-dependent 5' nuclease activity lie in the polymerase domain of the protein. Therefore, study of structural data of the polymerase domain with respect to nucleic acid recognition provides one method of locating amino acids that, when altered, alter RNA recognition in a 5' nuclease reaction. For example, analysis conducted during the development of the present invention examined published analyses relating to primer/template binding by the polymerase domain of E. coli Pol 1, the Klenow fragment. Table 2 shows a sampling of kinetic constants determined for the Klenow fragment, and shows the effects a number of mutations on these measurements. The corresponding or similarly positioned amino acids in the TaqPol are indicated in the right hand column. It was postulated that mutations having a noticible impact on the interactions of the Klenow fragment with the DNA template or the primer/template duplex, as indicated by changes in $K_d$ and Relative DNA affinity values, might also have effects when made at the corresponding sites in TaqPol and related chimerical or mutant derivatives. A selection of the mutations that produced a higher $K_d$ value or a lower Relative DNA affinity value when introduced into the Klenow fragment were created and examined in TaqPol. These Taq derivatives include, but are not limited to, those indicated by asterisks in the right hand column of Table 2.

For some Klenow variants, such as the R682 mutants, selection for testing was not made based on the DNA affinity measurements, but because molecular modeling suggested interaction between some aspect of the template/primer duplex and that amino acid. Similarly, additional regions of Taq polymerase (or Taq derivatives) were targeted for mutagenesis based on structural data and information from molecular modeling. Based on modeling, the thumb region was postulated to contact an RNA template. Thus, amino acids in the thumb region were looked for that, if altered, might alter that contact. For example, FIGS. 6 and 17 show that amino acids 502, 504, and 507 are located at the tip of the thumb. It was postulated that altering these amino acids might have an affect on the enzyme-substrate interaction. Using the activity screening methods described In Example 1, mutations that produced beneficial effects were identified. This approach was used to create a number of improved enzymes. For example, TaqPol position H784, corresponding to Klenow amino acid H881, is an amino acid in the fingers region and, as such, may be involved in primer/template substrate binding. When the H881 amino acid in the Klenow enzyme is replaced by alanine, the change decreases the affinity of the enzyme for DNA to only 30 to 40% of the wild type level. An analogous substitution was tested in a TaqPol-derived enzyme. Starting with the Taq derivative W417L/G418K/E507Q, amino acid 784 was changed from Histidine (H) to Alanine (A) to yield the W417L/G418K/E507Q/H784A mutant, termed Taq 4M. This variant showed improved 5' nuclease activity on the RNA test IrT1 (FIG. 24) test substrate (data in Table 3). Amino acid R587 is in the thumb region, and was selected for mutation based on its close proximity to the primer/template duplex in computer models. When an R587A mutation was added to the Taq 4M variant, the activity on the test IrT1 test substrate was still further improved. In addition, the reduction, relative to the 4M variant, in cleavage of the X structure shown in FIG. 22 constitutes an additional improvement in this enzyme's function.

Not all amino acid changes that reduce DNA binding in the polymerization affect the 5' nuclease activity. For example, mutations E615A, R677A, affecting amino acid that are also in the thumb and fingers domains, respectively, have either adverse effect, or no effect on the 5' nuclease activities, respectively, as measured using the test substrates in FIGS. 21 and 22, and compared to the parent variants that lacked these changes. The R677A mutation was added to, and compared with the TaqSS variant, while the E615A mutation was added to and compared with the Taq 4M variant. The test methods described herein provide a convenient means of analyzing any variant for the alterations in the cleavage activity of both invasive an noninvasive substrates, for both DNA and RNA containing structures. Thus, the present invention provides methods for identifying all suitable improved enzymes.

Alterations that might increase the affinity of the enzymes for the nucleic acid targets were also examined. Many of the mutations described above were selected because they caused the Klenow fragment enzyme to have decreased affinity for DNA, with the goal of creating enzymes more accepting of structures containing non-DNA strands. In general, the native DNA polymerases show a lower affinity for RNA/DNA duplexes, compared to their affinity for DNA/DNA duplexes. During the development of the present invention, it was sought to increase the general affinity of the proteins of the present invention for a nucleic acid substrate without restoring or increasing any preference for structures having DNA rather than RNA target strands. The substitution of amino acids having different charges was examined as a means of altering the interaction between the proteins and the nucleic acid substrates. For example, it was postulated that addition of positively charged amino acid residues, such as lysine (K), might increase the affinity of a protein for a negatively charged nucleic acid.

As noted above, alterations in the thumb region could affect the interactions of the protein with the nucleic acid substrate. In one example, the mutation G504K (tip of the thumb) was introduced in Taq4M and caused and enhancement of nuclease activity by 15% on an RNA target. Additional positively charged mutations (A502K and E507K) further improve the RNA target dependent activity by 50% compared to the parent Taq4M enzyme.

The use of data from published studies and molecular modeling, in combination with results accrued during the development of the present invention allowed the identification of regions of the proteins in which changes of amino acids would be likely to cause observable differences in at least one aspect of cleavage function. While regions could be targeted in this way, it was observed that changes in different amino acids, even if near or immediate neighbors in the protein, could have different effects. For example, while the A502K substitution created a marked increase in the RNA-dependent cleavage activity of Taq 4M, changing amino acid 499 from G to a K, only 3 amino acids away from 502, gave minimal improvement. As can be seen in the Experimental Examples, the approach of the present invention was to change several amino acids in a candidate region, either alone or in combination, then use the screening method provided in Example 1 to rapidly assess the effects of the changes. In this way, the rational design approach is easily applied to the task of protein engineering.

In addition to the thumb, palm, and hand regions found in the polymerase domain of these proteins, regions that are specific to 5' nucleases and nuclease domains were examined. Comparative studies on a variety of 5' nucleases have shown that, though the amino acid sequences vary dramatically from enzyme to enzyme, there are structural features common to most. Two of these features are the helix-hairpin-helix motif (H-h-H) and the arch or loop structure. The H-h-H motif is believed to mediate non-sequence specific DNA binding. It has been found in at least 14 families of proteins, including nucleases, N-glycosylases, ligases, helicases, topoisomerases, and polymerases (Doherty et al., Nucl. Acid. Res., 24:2488 [1996]). The crystallographic structure of rat DNA polymerase pol $\beta$ bound to a DNA template-primer shows non-specific hydrogen bonds between the backbone nitrogens of the pol $\beta$ HhH motif and the phosphate oxygens of the primer of the DNA duplex (Pelletier et al, Science 264:1891 [1994]). Because the HhH domain of 5' nuclease domains of Taq and Tth polymerases may function in a similar manner, it is contemplated that mutations in the HhH region of the enzyme alter activity. Mutations may be introduced to alter the shape and structure of the motif, or to change the charge of the motif to cause increased or decreased affinity for substrate.

Another structure common to many 5' nucleases from diverse sources such as eukaryotes, eubacteria, archaea and phage, is the arch or loop domain. The crystal structure of the 5' exonuclease of bacteriophage T5 showed a distinct arch formed by two helices, one positively charged and one containing hydrophobic residues (Ceska et al., Nature 382: 90 [1996]). Interestingly, three residues that are conserved between T5 and Taq, Lys 83, Arg 86 and Tyr 82 are all in the arch. These correspond to amino acids Lys 83, Arg 86, and Tyr 82 in Taq DNA polymerase. The crystal structure for Taq (5' nuclease) has also been determined (Kim et al., Nature 376:612 [1995]).

The crystal structure from the flap endonuclease-1 from *Methanococcus janneschii* also shows such a loop motif (Hwang et al., Nat. Struct. Biol., 5:707 [1998]). The backbone crystal structure of Mja FEN-1 molecules may be superimposed on T5 exonuclease, Taq 5'-exonuclease and T4 RNase H. An interesting feature common to all of these is the long loop. The loop of FEN-1 consists of a number of positively charged and aromatic residues and forms a hole with dimensions large enough to accommodate a single-stranded DNA molecule. The corresponding region in T5 exonuclease consists of three helices forming a helical arch. The size of the hole formed by the helical arch in T5 exonuclease is less than half that formed by the LI loop in Mj FEN-1. In T4 RNase H or Taq 5' exonuclease, this region is disordered. Some regions of the arch bind metals, while other regions of the arch contact nucleic acid substrate. Alignment of the amino-acid sequences of six 5' nuclease domains from DNA polymerases in the pol I family show six highly conserved sequence motifs containing ten conserved acidic residues (Kim et al., Nature 376 [1995]).

The effects of alterations in the arch region were examined. In Taq polymerase the arch region is formed by amino acids 80–95 and 96–109. Site directed mutagenesis was performed on the arch region. Alignment of amino acid sequences of the FEN and polymerase 5' nucleases suggested the design of 3 amino acid substitution mutations, P88E, P90E and G80E. These substitutions were made on the Taq4M polymerase mutant as a parent enzyme. Results indicated that although the background activity on the HP and X substrates shown in FIG. 22 are tremendously suppressed in all mutants, the desirable 5' nuclease activity on proper substrates (IdT and IrT, FIG. 24) is also reduced. Despite the sequence homology between Taq and Tth polymerases, they have very different activity on HP and X substrates. The alignment of the Taq and Tth polymerase arch regions also demonstrates regions of extensive sequence homology as well as minor differences. These differences led to the design of mutations L109F and A110T using Taq4M to generate Taq4M L109F/A110T, and the mutant Taq 4M A502K/G504K/E507K/T514S to generate Taq 4M L109F/A110T/A502K/G504K/E507K/T514S mutant. These two mutations have drastically converted Taq4M enzyme to become more like Tth enzyme in terms of the background substrate specificity while the 5' nuclease activities on both DNA and RNA substrates are almost unchanged.

4) Focused Random Mutagenesis

As described above, physical studies and molecular modeling may be used alone or in combination to identify regions of the enzymes in which changes of amino acids are likely to cause observable differences in at least one aspect of cleavage function. In the section above, use of this information was described to select and change specific amino acids or combinations of amino acids. Another method of generating an enzyme with altered function is to introduce mutations randomly. Such mutations can be introduced by a number of methods known in the art, including but not limited to, PCR amplification under conditions that favor nucleotide misincorporation (REF), amplification using primers having regions of degeneracy (i.e., base positions in which different individual, but otherwise similar oligonucleotides in a reaction may have different bases), and chemical synthesis. Many methods of random mutagenesis are known in the art (Del Rio et al., Biotechniques 17:1132 [1994]), and may be incorporated into the production of the enzymes of the present invention. The discussions of any particular means of mutagenesis contained herein are presented solely by way of example and not intended as a limitation. When random mutagenesis is performed such that only a particular region of an entire protein is varied, it can be described as "focused random mutagenesis." As described in the Experimental Examples, a focused random mutagenesis approach was applied to vary the HhH and the thumb domains some of the enzyme variants previously created. These domains were chosen to provide examples of this approach, and it is not intended that the random mutagenesis approach be limited to any particular domain, or to a single domain. It may be applied to any domain, or to any entire protein. Proteins thus modified were tested for cleavage activity in the screening reactions described in Example 1, using the test substrates diagrammed in FIGS. 22 and 24, with the results described in Tables 6 and 7.

Random mutagenesis was performed on the HhH region with the parent TaqSS or TthDN H785A mutants. None of the 8 mutants generated showed an improvement in activity compared to the parent enzyme (Table 6). In fact, mutations of the region between residues 198–205 have about 2–5 fold lower activity on both DNA and RNA substrates, suggesting that this region is essential for substrate recognition. Mutagenesis in the thumb region resulted in new mutations that improved 5' nuclease activity by 20–100% on a DNA target and about 10% on an RNA target (Table 7).

Numerous amino acids in each of the distinct subdomains play roles in substrate contact. Mutagenesis of these may alter substrate specificity by altering substrate binding. Moreover, mutations introduced in amino acids that do not directly contact the substrate may also alter substrate specificity through longer range or general conformation altering effects. These mutations may be introduced by any of several methods known in the art, including, but not limited to random mutagenesis, site directed mutagenesis, and generation of chimeric proteins.

As noted above, numerous methods of random mutagenesis are known in the art. The methods applied in the focused random mutagenesis described herein may be applied to whole genes. It is also contemplated that additional useful chimerical constructs may be created through the use of molecular breeding (See e.g., U.S. Pat. No. 5,837,458 and PCT Publications WO 00/18906, WO 99/65927, WO 98/31837, and WO 98/27230, herein incorporated by reference in their entireties). Regardless of the mutagenesis method chosen, the rapid screening method described herein provides a fast and effective means of identifying beneficial changes within a large collection of recombinant molecules. This makes the random mutagenesis procedure a manageable and practical tool for creating a large collection of altered 5' nucleases having beneficial improvements. The cloning and mutagenesis strategies employed for the enzymes used as examples are applicable to other thermostable and non-thermostable Type A polymerases, since DNA sequence similarity among these enzymes is very high. Those skilled in the art would understand that differences in sequence would necessitate differences in cloning strategies, for example, the use of different restriction endonucleases may be required to generate chimeras. Selection of existing alternative sites, or introduction via mutagenesis of alternative sites are well established processes and are known to one skilled in the art.

Enzyme expression and purification can be accomplished by a variety of molecular biology methods. The examples described below teach one such method, though it is to be understood that the present invention is not to be limited by the method of cloning, protein expression, or purification. The present invention contemplates that the nucleic acid construct be capable of expression in a suitable host. Numerous methods are available for attaching various promoters and 3' sequences to a gene structure to achieve efficient expression.

5) Site-Specific Mutagenesis

In some embodiments of the present invention, any suitable technique (e.g., including, but not limited to, one or more of the techniques described above) are used to generate improved cleavage enzymes (e.g., SEQ ID NO:221) with heterologous domains. Accordingly, in some embodiments, site-specific mutagenesis (e.g., primer-directed mutagenesis using a commercially available kit such as the Transformer Site Directed mutagenesis kit (Clontech)) is used to make a plurality of changes thoughout a nucleic acid sequence in order to generate nucleic acid encoding a cleavage enzyme of the present invention. In some embodiments, a plurality of primer-directed mutagenesis steps are carried out in tandem to produce a nucleic acid encoding a cleavage enzyme of the present invention.

In some embodiments, a plurality of primer directed mutagenesis steps are directed to a selected portion of a nucleic acid sequence, to produce changes in a selected portion of a cleavage enzyme of the present invention. In other embodiments, a nucleic acid having changes in one selected portion is recombined with a nucleic acid having mutations in a different selected portion (e.g., through cloning, molecular breeding, or any of the other recombination methods known in the art), thereby creating a nucleic acid having mutations in a plurality of selected portions, and encoding a cleavage enzyme of the present invention. The mutations in each selected portion may be introduced by any of the methods described above, or any combination of said methods, including but not limited to methods of random mutagenesis and site-directed mutagenesis.

For example, in one illustrative embodiment of the present invention, the nucleic acid sequence of SEQ ID NO:222 (a nucleic acid sequence encoding the cleavage enzyme of SEQ ID NO:221) is generated by making a plurality of primer-directed mutations to the nucleic acid sequence of SEQ ID NO: 104 (see Example 7 for the construction of SEQ ID NO:104). In some embodiments, each mutation is introduced using a separate mutagenesis reaction. Reactions are carried out sequentially such that the resulting nucleic acid (SEQ ID NO: 222) contains all of the mutations. In another illustrative embodiment of the present invention, the nucleic acid sequence of SEQ ID NO:222 is generated by making a plurality of primer-directed mutations, as described above, in the nuclease portion (e.g., as diagrammed in FIG. 6) of SEQ ID NO:111. The mutant nuclease portion is then combined with the "polymerase" portion of SEQ ID NO:104 at the Not I site, using the recombination methods described in Example 4, thereby creating a single nucleic acid having SEQ ID NO:222, and encoding the cleavage enzyme of SEQ ID NO:221. Following mutagenesis, the resulting altered polypeptide is produced and tested for cleavage activity using any suitable assay (e.g., including, but not limited to, those described in Examples 1 and 6). In some embodiments, the nucleic acid sequence encoding the cleavage enzyme of SEQ ID NO:221 (e.g., SEQ ID NO:222) is further modified using any suitable method.

V. Reaction Design for INVADER Assay Detection of RNA Targets;

Approaches to designing INVADER assays for the detection of RNA targets can vary depending on the needs of a particular assay. For example, in some embodiments, an RNA to be detected or analyzed may be present in a test sample at low levels, so a high level of sensitivity (i.e., a low limit of detection, or LOD) may be desirable; in other embodiments, an RNA may abundant, and may not require an especially sensitive assay for detection. In some embodiments, an RNA to be detected may be similar to other RNAs in a sample that are not intended to be detected, so that a high level of selectivity in an assay is desirable, while in other embodiments, it may be desired that multiple similar RNAs be detected in a single reaction, so an assay may be provided that is not selective with respect to the differences among these similar RNAs.

In some embodiments it is especially desirable to avoid detection of any DNA molecules related to the target RNA molecules in a reaction. In some embodiments, this is accomplished by designing INVADER assay probe sets to RNA splice junctions, such that only the properly spliced mRNAs provide the selected target sites for detection. In other embodiments, samples are handled such that DNA remains double stranded (e.g., the nucleic acids are not heated or otherwise subjected to denaturing conditions), and is thus not available to serve as target in an INVADER assay reaction. In other embodiments, cells are lysed under conditions that leave nuclei intact, thereby containing and preventing detection of the genomic DNA, while releasing the cytosolic mRNAs into the lysate solution for detection by the assay.

In some embodiments, the INVADER assay is to be used for detection or quantitation of an entire RNA having a particular variation of a sequence (e.g., a mutation a SNP, a particular spliced junction); in such embodiments, the location of the base or sequence to be detected is a determining factor in the selection of a site for the INVADER assay probe set to hybridize. In other embodiments, any portion of an RNA target may be used to indicate the presence or the amount of the entire RNA (e.g., as in gene expression analysis). In this case, the probe sets may be directed toward a portion of the RNA selected for optimal performance (e.g., sites determined to be particularly accessible for probe hybridization) as a target in the INVADER assay.

The discussion of INVADER assay probe design is divided into the following sections:
i. Target site selection based on accessibility
ii. Target site selection based on selectivity
iii. Oligonucleotide design
   a. Target-specific regions: length and melting temperature
   b. Non-complementary regions
   c. Folding and dimer analysis
iv. Assay performance evaluation
v. Design and assay optimization i. Target Site Selection Based on Accessibility One consideration in the selection of sites for detection is the availability of the target site for hybridization of the assay probe set. To simply use randomly selected complementary oligonucleotides for a given RNA target without prior knowledge of regions of the RNA that allow efficient hybridization can be an ineffective approach. For example, it is estimated that targeting RNA with antisense oligonucleotides based on random design results in one out of 18–20 tested oligonucleotides showing significant inhibition of gene expression (Sczakiel, Fronteirs in Biosciences 5:194 [2000]; Patzel et al, Nucleic Acids Res., 27:4328 [1999]; Peyman et al., Biol. Chem. Hoppe-Seyler 367:195 [1995]; Monia et al., Nature Med., 2:668 [1996]). Secondary and tertiary structures of RNA are thought to be the major reasons that influence the ability of an oligonucleotide to bind targeted regions of the RNA (Vickers et al., Nucleic Acids Res., 28:1340 [2000]; Lima et al., Biochemistry 31:12055 [1992]; Uhlenbeck, J. Mol. Biol., 65:25 [1972]; Freier and Tinoco, Biochemistry 14:3310 [1975]). This is due to the hybridization kinetics and thermodynamics of destroying any structural motifs of the RNA and, in return, hybridizing the complementary DNA oligonucleotide (Patzel et al., Nucleic Acids Res., 27:4328 [1999]; Mathews et al., RNA 5:1458 [1999]). Thus, the ability to identify regions of RNA that are "accessible" for hybridization is important for design and selection of effective oligonucleotides.

There are several experimental and theoretical methods available for identifying accessible regions in RNA. These include the use of RNase-H footprinting (Ho et al., Nature Biotechnology 16:59 [1998]; Mateeva et al., Nucleic Acids Res., 25:5010 [1997]; Mateeva et al., Nature Biotechnology 16:1374 [1998]), complementary arrays of oligonucleotide libraries (Southern et al., Nucleic Acids Res., 22:1368 [1994]; Mir and Southern, Nature Biotechnology 17:788 [1999]), ribozyme libraries with random hexamer internal guide sequences (Campbell and Cech, RNA 1:598 [1995]; Lan et al., Science 280:1593 [1998]), and RNA and DNA structure prediction computer programs (Sczakiel, Frontiers in Biosciences 5:194 [2000]; Patzel et al., Nucleic Acids Res., 27:4328 [1999]; Zuker, Science 244:48 [1989]; Walton et al., Biotechnol. Bioeng., 65:1 [1999]). Recently, new methods have been developed that use primer extension to identify sites in RNAs that are accessible for hybridization. Target nucleic acids (e.g., mRNA target nucleic acids) are contacted with a plurality of primers containing a 3' a region of degenerate sequence and primer extension reactions are conducted. Where the target nucleic acid is an RNA molecule, preferred enzymes for use in the extension reactions are reverse transcriptases, which produce a DNA copy of the RNA template. Folded structures present in the target nucleic acid affect the initiation and/or efficiency of the extension reaction. The extension products of the primers are analyzed to provide a map of the accessible sites. For example, certain extension products are not generated where the primer is complementary to a sequence that is involved in a folded structure. Regions of the target nucleic acid that do not allow hybridization of the primer and do not result in the production of an extension product are considered inaccessible sites. In contrast, the presence of an extension product indicates that the primer was able to bind to an accessible region of the target nucleic acid. Such methods are referred to herein as "reverse transcription with random oligonucleotide libraries" or "RT-ROL" (H T Allawi, et al., RNA 7(2):314–27 [2001]; PCT Publication WO 01/98537, incorporated herein by reference in its entirety). The use of a physical measurement such as RT-ROL or array hybridization provides the most direct evidence of the accessibility of a site on an RNA strand. In general, INVADER assays directed toward accessible regions produce stronger signals for a given amount of RNA than assays directed toward less accessible regions of an RNA strand. For the detection of rare RNAs (e.g., fewer than about 5,000 to 10,000 copies per INVADER assay reaction), or in any assay wherein it is desirable to have the best (i.e., lowest) limit of detection possible, it may be beneficial to start the assay design by analyzing the RNA structure using RT-ROL or another method of physical analysis.

In other embodiments, ease of assay design may be more important than creation of an assay with a particularly low LOD. Structure prediction software can simplify the task of determining which parts of an RNA are likely to be single stranded, and thus be more accessible for probe hybridization. As first step, the sequence of an RNA to be detected is entered into an electronic file. It may be entered manually or imported from a file (e.g., a sequence data file, or a word processing file). In some embodiments, the sequence is downloaded from a database, such as GenBank or EMBL. The RNA sequence can then be analyzed using a program such as mfold (Zucker, Science 244:48 [1989]), OligoWalk (Mathews et al., RNA 5:1458 [1999]), and variations of both (Sczakiel, Frontiers in Biosciences 5:194 [2000]; Patzel et al., Nucleic Acids Res., 27:4328 [1999]; Walton et al., Biotechnol. Bioeng., 65:1 [1999]).

Mfold Analysis for Target RNA Structure Prediction.

The output of mfold analysis can be used in several ways to assist in identifying accessible regions of an RNA target molecule. In one embodiment, the mfold program is used to generate an "ss count" file for identifying regions least likely to be involved in intra-strand basepairing. In another embodiment, the mfold program is used to generate a ".ct" file, a file used as input information for use with RNA Structure 3.5 to perform an OligoWalk analysis. In preferred embodiments, for either use, the sequence to be detected is entered into mfold. In a preferred embodiment, the settings used in the mfold analysis include:

Folding Temperature: 37° C. (Even though the INVADER reaction may not be conducted at this temperature.)
% Suboptimality: 5
foldings: 50
Window Parameter: Default
Maximum distance between paired bases: No Limit
Select BATCH folding
Enter:an e mail address where the results are to be sent when ready
Image Resolution: High
Structure Format: Bases
Base Number Frequency:Default
Structure Rotation Angle: 0
Structure Annotation: SS-Count
1M NaCl (Australian mfold Internet site only)

When results are ready, an e mail message is sent containing the Web address of the results. The only file that is necessary for subsequent INVADER assay probe design analysis is the SS-Count file, which is then downloaded from the Results page. An exemplary mfold analysis using a GenBank entry for Human Ubiquitin (#4506712) is shown below:

SS-Count Analysis for Accessible Sites Identification.

Figure 39:
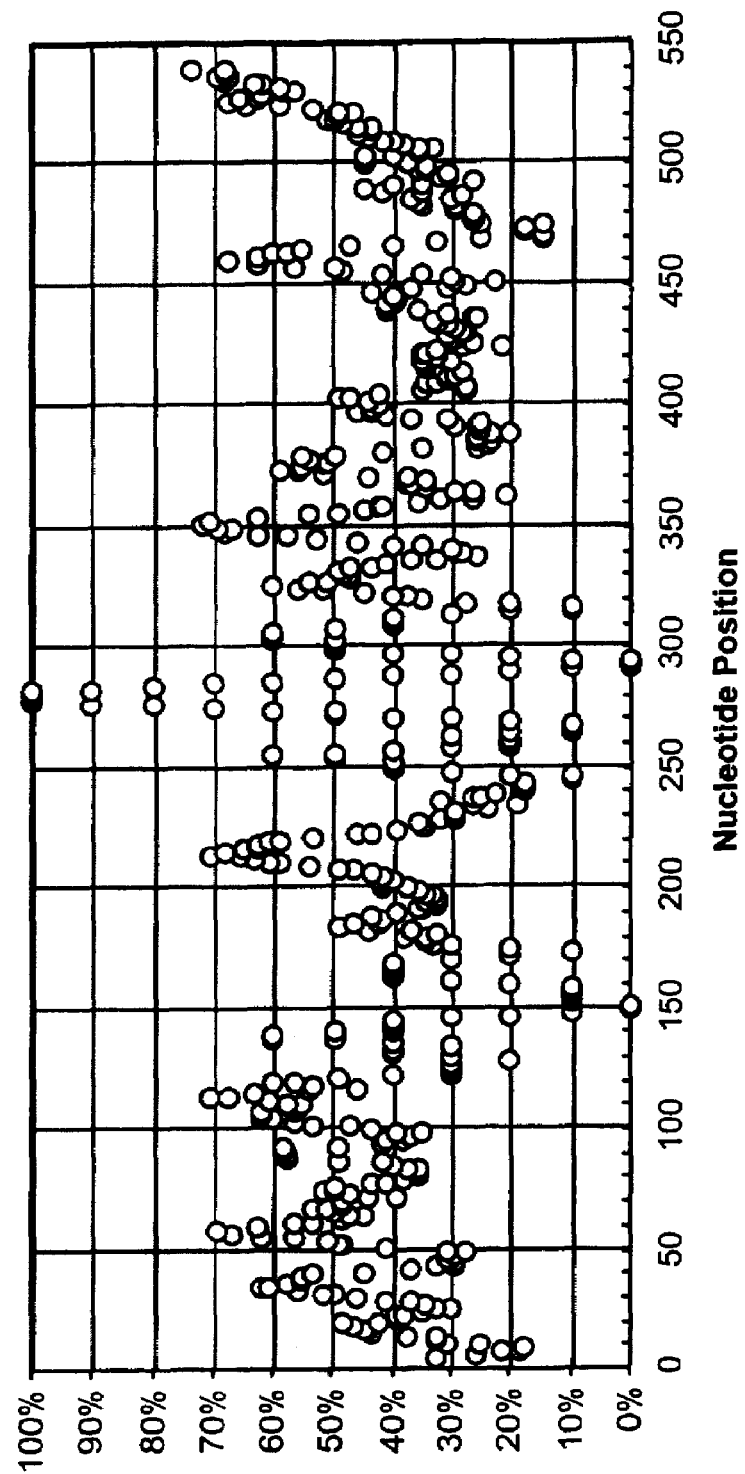
FIG. 39 shows a graph of the calculated running average of a ten nucleotide stretch of the hUbiquitin RNA (the Ave(10) Index) derived from the SS-count output of an mfold analysis, expressed as a percentage of the total number of structures found by mfold that include a particular base, plotted against the position of the base.

The SS-Count file is then imported into an Excel spreadsheet file and the following options are chosen: Data Type=Delimited <press Next>; Delimited=Select (x) Spaces; (x) Treat multiple delimiters as one <press Next>; Column for data format=General. Selecting these options results in the import into Excel of three columns of data (FIG. 39). The first line in the first column is the total number of stable structures mfold found under the parameters used in the folding. With the Ubiquitin example, there were 12 structures found.

The rest of the first column is the RNA nucleotide position numbered from 1. The second column is the raw SS-Count number and represents the number of times the corresponding base was NOT base-paired as part of some secondary structure. The third column is the sequence of the RNA analyzed, identifying the base at each numbered position. By looking for bases that are involved in fewer structures (i.e., bases listed in column 3 corresponding to the higher numbers in column 2), it is possible to identify regions of the mRNA (identified by position number in column 1) that are more likely to be free of intra-strand base-pairing, and thus are more likely to be available for detection using the INVADER assay.

One way of viewing the data is to calculate the running average SS-count for a ten nucleotide stretch of the RNA (the Ave(10) Index) and chart the Ave(10) Index against the base pair position (See e.g., FIG. 48).

An alternative plot is to graph the nucleotide position against the Ave(10) Index expressed as a percentage of the total number of structures found by mfold (FIG. 39). As with the raw SS-count table, regions of the RNA corresponding to higher numbers in the Ave(10) Index are involved in fewer predicted folded structures. Viewing the Ave(10) Index in either a chart or graph format reduces the complexity of the data, and can reveal longer stretches of the RNA that are more likely to be structure-free. For example, from the graph of the running average, a user can pick out all of the major peak areas as likely regions for INVADER assay probe design. This creates an SS-Count Candidate List. In the Human ubiquitin example, there is one major peak and about 6 other peaks (FIG. 39)

The next step is to refer back to the raw (i.e., not the running average) SS-Count data from within each of the peak areas, and identify the residue where the running average is changing in magnitude, this is a local "turn" and is generally a good candidate residue to be positioned at the INVADER assay probe set cleavage site. For example, in Human Ubiquitin, residue G119 is found at a minor local turn within a globally accessible region (FIG. 40). The INVADER assay probe set with the cleavage site at this location is a good performer in detection of this RNA. Placing the cleavage site at G114 did not result in better detection even though it had a higher %Ave(10) value. While not limiting the present invention to any particular mechanism, and an understanding of the mechanism is not necessary to practice the invention, this is likely to be because this area was less accessible to the Probe or INVADER oligonucleotides than was position G119.

OligoWalk Structure Prediction with RNA Structure 3.5 for Accessible Sites Identification In some embodiments, the program OligoWalk, a module of the software "RNAStructure" (Mathews et al., RNA 5:1458 [1999]) is used in the selection of sites that are more likely to be accessible for oligonucleotide binding. OligoWalk uses sets of thermodynamic parameters for both RNA and DNA, and their hybrids (Allawi and SantaLucia, Biochemistry 36:10581 [1997]; Mathews et al., J. Mol. Biol., 288:911 [1999]; Sugimoto et al., Biochemistry 34:11211 [1995]) in an algorithm that relies on mfold for RNA secondary structure prediction (Zucker, Science 244:48 [1989]). OligoWalk is designed to predict the most favorable regions of an RNA target for designing antisense oligonucleotides by estimating the overall thermodynamics of hybridizing an antisense oligomer to the RNA by taking into account the thermodynamics of destroying any structural motifs in the RNA target or the antisense oligonucleotide. The affinity of the oligomer to its target is expressed as an overall Gibbs free energy change of a self-structured oligomer, and of a target associating into an oligomer-target complex. This free energy is usually a negative number, indicating favorable binding, and is expressed in 'kcal/mol' units. OligoWalk analysis is performed with 8 to 15 base oligonucleotide size to resemble the average length of the analyte specific region of the Signal Probe. Plotting the total binding energy against the length of the RNA generates a graph of peaks and valleys. The lowest negative values generally indicate the most favorable sites for oligonucleotides to bind. The most inaccessible regions have positive binding energy values, and generally are a poor sites for assay probe design In a preferred embodiment, the OligoWalk module of RNA Structure 3.5 is used to determine binding energies by performing an 8-base OligoWalk using the following settings:
Break Local Structure
Include suboptimal structures
Oligo Length: 8 nt
Oligo Concentration: 100 nM
Oligo Type: DNA
Walk entire Target RNA When these parameters have been set, the sequence file to be folded (the ".ct" output file from mfold) can be selected and opened. Once the sequence has been folded, a report can be created using the Output menu. The report is imported into Excel and the data generated above is plotted. In a preferred embodiment, the OligoWalk data is graphed with the SS-Count data. The regions displaying the lowest free energy values (i.e., the largest negative numbers) are generally the most likely to be accessible for hybridization. In preferred embodiments, the 3' end and the majority of the target-binding region of the probe oligonucleotide complement an accessible region of the target RNA. In particularly preferred embodiments, the majority of the binding site for the corresponding INVADER oligonucleotide falls within the same accessible region. In another preferred embodiment, the binding site for an INVADER oligonucleotide falls within a nearby accessible region.

An INVADER oligonucleotide can generally be positioned to bind to a less accessible site. While not limiting the present invention to any particular mechanism, it is observed that the INVADER oligonucleotides are generally longer than probe oligonucleotides used in the INVADER assay reactions and, because they are generally designed to remain bound to the target at the reaction temperature, they will be selected to have a $T_m$s about 12 to 15° C. higher than that of a corresponding probe. Consequently, INVADER oligonucleotides may more readily break the local target structure, and thus may be less dependent on the accessibility of the target-binding site.

In selecting among accessible sites for the design of INVADER assay oligonucleotides, the base composition of the site is also considered. It has been observed that stretched of more than 4 or 5 of the same nucleotide in a row (e.g., ... AAAA ... or ... CCCC ... ) in any portion of the binding site for the assay oligonucleotides may reduce the performance of the probe set in the assay (e.g., by increasing background or decreasing specificity). Thus, in preferred embodiments, any stretches comprising four or more repeated bases are generally avoided. Another consideration is the effect of base composition on lengths of the oligonucleotides in the probe set. In many cases, targeting A-T rich sequences requires the use of longer oligonucleotides for a reaction performed at a given temperature, compared to the length of oligonucleotides targeted to sequences having a more even distribution of A-T and G-C bases. Longer oligonucleotides can be more prone to formation of intrastrand structures and dimer structures. Thus, it is preferred that the distribution or A-T bases and G-C bases within a target region be as close to even (i.e., about 50% G-C content) as the region to be detected permits. In particularly preferred embodiments, the distribution of A-T and G-C positions is evenly distributed across the binding sites (e.g., not having all A-T positions in one half, with all G-C positions in the other).

ii. Target Site Selection Based on Selectivity

In some embodiments, probe sets are designed to examine highly homologous, or closely related RNA targets (i.e., targets that are very similar in sequence). In such embodiments, the RNA or homologous cDNA sequences are compared, e.g., using an alignment program such as MEGA-LIGN (DNAstar Madison, Wis.).

In some embodiments, selectivity is provided by designing probe sets to detect splice junctions. Splice junctions can be identified by aligning the cDNA and gene sequences using an alignment program (e.g. MEGALIGN) or under the BLAST menu at the NCBI website (BLAST 2 sequences). Splice junctions are also often listed in the GenBank report (intron/exon sites). INVADER assay oligonucleotide sets are designed such that the probe and INVADER oligonucleotides are complementary to the coding strand (mRNA), generally with the cleavage site being as close to the splice junction as possible. In some embodiments, different splice junctions within an mRNA are analyzed for accessibility, as described above. In preferred embodiments, probe sets are designed to detect one or more splice junctions showing greater accessibility compared to the accessibility of other splice junctions within the same RNA target.

In some embodiments designed to exclude detection of RNAs related to the target RNA, sequences are examined to identify bases that are unique to the target RNA when compared to the other similar sequences from which the target is distinguished. Generally, the unique base is positioned to hybridize to the 5' end of the target-specific region of the probe oligonucleotide. In some embodiments, two adjacent bases are unique to the target compared to the related RNA. If two adjacent unique bases are available in an appropriately accessible portion of the target RNA, it is preferred that these bases be used as the site around which the probe and INVADER oligonucleotides sets are designed. In some embodiments, the two unique bases are positioned such that the site of cleavage of the probe is between the two base-pairs they form with the probe. In other embodiments, one of the unique bases is in the last position of the hybridization site of the INVADER oligonucleotide (i.e., it is positioned to base-pair to the penultimate residue on the 3' end of the INVADER oligonucleotide).

In some embodiments, the assay is designed to include detection of RNAs that are similar, but not identical, to the target RNA. If the assay is being designed for inclusive detection, the compared sequences are examined to identify sites having complete homology. Such designs can be created to detect homologous sequences in the same species or between species. Generally, the most homologous regions are selected as hybridization targets for probe oligonucleotides. Generally, some variation can be tolerated, for example, if it is not at the base that would hybridize to the 5' end of the target-specific region of a probe. In some embodiments, variation is accommodated by the use of degenerate bases in the INVADER assay oligonucleotides (e.g., mixtures of bases are used at positions within the synthesized probe, INVADER and/or stacker oligonucleotides, said mixtures selected to complement the mixture of specific bases present in the collection of related target RNAs).

iii. Oligonucleotide Design a. Target-Specific Regions: Length and Melting Temperature As described above in Section I (a) concerning the oligonucleotide design, in some embodiments, the length of the analyte-specific regions are defined by the temperature selected for running the reaction. Starting from the desired position (e.g., a variant position or splice junction in a target RNA, or a site corresponding to a low free energy value in an OligoWalk analysis) an iterative procedure is used by which the length of the ASR is increased by one base pair until a calculated optimal reaction temperature ($T_m$ plus salt correction to compensate for enzyme and any other reaction conditions effects) matching the desired reaction temperature is reached. In general probes are selected to have an ASR with a calculated $T_m$ of about 60° C. if a stacking oligonucleotide is not used, and a $T_m$ of about 50 to 55° C. if a stacking oligonucleotide is used (a stacking oligonucleotide typically raises the $T_m$ of a flanking probe oligonucleotide by about 5 to 15° C.). If the position of variation or a splice junction is a starting position, then the additions are made to the 3' end of the probe. Alternatively, if the 3' end of the probe is to be positioned at the most accessible site, the additions are in the 5' direction. In some embodiments, wherein a stacker oligonucleotide is to be used, it is preferred that the probe be designed to have a 3' base that has stable stacking interaction interface with the 5' base of the stacker oligonucleotide. The stability of coaxial stacking is highly dependent on the identity of the stacking bases. Overall, the stability trend of coaxial stacking in decreasing order is purine:purine>purine:pyrimidine≈pyrimidne: purine>pyrimidine:pyrimidine. In other embodiments employing a stacker, a less stable stacking interaction is preferred; in such cases the probe 3' base and/or the stacker 5' base are selected to provide a leass stable stacking interaction. In some embodiments, the probe 3' base and/or the stacker 5' base are selected to have a mismatch with respect to the target strand, to reduce the strength of the stacking interaction.

The same principles are also followed for INVADER oligonucleotide design. Briefly, starting from the position N, additional residues complementary to the target RNA starting from residue N-1 are then added in the upstream direction until the stability of the INVADER-target hybrid exceeds that of the probe (and therefore the planned assay reaction temperature). In preferred embodiments, the stability of the INVADER-target hybrid exceeds that of the probe by 12–15° C. In general, INVADER oligonucleotides are selected to have a $T_m$ near 75° C. Software applications, such as INVADERCREATOR (Third Wave Technologies, Madison, Wis.) or Oligonucleotide 5.0 may be used to assist in such calculations.

If a stacking oligonucleotide is to be used, similar design principles are applied. The stacking oligonucleotide is generally designed to hybridize at the site adjacent to the 3' end of the probe oligonucleotide, such that the stacker/target helix formed can coaxially stack with the probe/target helix. The sequence is selected to have a calculated $T_m$ of about 60 to 65° C., with the calculation based on the use of natural bases. However, stacking oligonucleotides are generally synthesized using only 2'-O-methyl nucleotides, and consequently, have actual $T_m$s that are higher than calculated by about 0.8° C. per base, for actual $T_m$s close to 75° C.

In some embodiments, ARRESTOR oligonucleotides are included in a secondary reaction. ARRESTOR oligonucleotides are provided in a secondary reaction to sequester any remaining uncleaved probe from the primary reaction, to preclude interactions between the primary probe and the secondary target strand. ARRESTOR oligonucleotides are generally 2'-O-methylated, and comprise a portion that is complementary to essentially all of their respective probe's target-specific region, and a portion that is complementary to at least a portion of the probe's flap regions (e.g., six nucleotides, counted from the +1 base towards the 5' end of the arm).

b. Non-Complementary Regions
  Probe 5' Arm Selection

The non-complementary arm of the probe, if present, is preferably selected (by an iterative process as described above) to allow the secondary reaction to be performed at a particular reaction temperature. In the secondary reaction, the secondary probe is generally cycling, and the cleaved 5' arm (serving as an INVADER oligonucleotide) should stably bind to the secondary target strand.

INVADER Oligonucleotide 3' Terminal Mismatch Selection

In preferred embodiments, the 3' base of the INVADER oligonucleotide is not complementary to the target strand, and is selected in the following order of preference (listed as INVADER oligonucleotide 3' base/target base):

| | |
|---|---|
| C in target | C/C > A/C > T/C > G/C |
| A in target | A/A > C/A > G/A > T/A |
| G in target | A/G > G/G > T/G > C/G |
| U in target | C/U > A/U > T/U > G/U | c. Folding and Dimer Analysis

In some embodiments, the oligonucleotides proposed for use in the INVADER assay are examined for possible inter- and intra-molecular structure formation in the absence of the target RNA. In general, it is desirable for assay probes to have fewer predicted inter- or intra molecular interactions. In some embodiments, the program OLIGO (e.g., OLIGO 5.0, Molecular Biology Insights, Inc., Cascade, Colo.) is used for such analysis. In other embodiments, the program mfold is used for the analysis. In yet other embodiments, the RNAStructure program can be used for dimer analysis. The following sections provide stepwise instructions for the use of these programs for analysis of INVADER assay oligonucleotides.

OLIGO 5.0 Analysis for Probe Structure and Interaction Prediction.

Analysis of INVADER oligonucleotides using OLIGO 5.0 comprises the following steps. All menu choices are shown in UPPER CASE type.

1. Launch OLIGO 5.0 and open a sequence file for each mRNA to be analyzed. This is done by using a menu to select the following
   Choose FILE–>NEW
   Paste in longest available sequence
   Choose ACCEPT & QUIT (F6)
2. Set Program settings to default
   Choose FILE–>RESET–>ORIGINAL DEFAULTS
3. Identify Probe Oligonucleotide
   Select OLIGO LENGTH to be around 16 nucleotides (open the menu for this option by using ctrl-L keystrokes).
   Move the cursor indicating the 5' end of the Current Oligo until the 3' end is located at the candidate cleavage site residue.
   Choose ANALYSE–>DUPLEX FORMATION–>CURRENT OLIGO (ctrl-D) for a rough determination of the extent of dimer and hairpin formation.
   Confirm length of analyte region corresponds with desired reaction temperature [e.g., through the use of $T_m$ calculation as described in the Optimization of Reaction Conditions, I(c) of the Detailed Description of the Invention]
   Select the "LOWER" button in OLIGO 5.0 to copy the anti-sense sequence (this will be the analyte-specific region of the actual probe oligonucleotide and is anti-sense to the RNA strand.)
   Import into a database file.
   Save to computer memory.
4. Identify INVADER Oligonucleotide
   Choose sequence adjacent to the probe oligonucleotide identified from step 3.
   Select OLIGO LENGTH to ~24 nucleotides
   Confirm length of analyte region corresponds with desired reaction temperature [e.g., through the use of $T_m$ calculation as described in the Optimization of Reaction Conditions, I(c) of the Detailed Description of the Invention, about 75° C. for INVADER oligonucleotides). Select the "LOWER" button in OLIGO 5.0 to copy the corresponding anti-sense sequence (this will be the analyte-specific region of the actual INVADER oligonucleotide.)

Import into a database file.

Save to computer memory.

5. Addition of Cleaved Arm Sequence and INVADER Oligonucleotide Mismatch Sequence.

Export the Probe oligonucleotide as Upper Primer.

Export the INVADER oligonucleotide as Lower Primer.

EDIT UPPER PRIMER to add in a candidate arm sequence (selected, for example, as described above).

Check that the arm sequence does not create new secondary structures (analysis performed as described above).

EDIT LOWER PRIMER to add in the 3' mismatched nucleotide that will overlap into the cleavage site (selected according to the guidelines for this mismatched bases, provided above).

Select all Upper and Lower Primer boxes in the "Print/Save Options"

PRINT ANALYSIS of Upper (Probe) and Lower (INVADER) oligonucleotides and check for lack of stable secondary structures.

Save both mRNA sequence and oligonucleotide sequence database files before quitting the program.

Generally, oligonucleotides having detected intra-molecular formations with stabilities of less than −6 ΔG are preferred. Less stable structures represent poor substrates for CLEAVASE enzymes, and thus cleavage of such structures is less likely to contribute to background signal. Probe and INVADER oligonucleotides having less affinity for each other are more available to bind to the target, ensuring the best cycling rates.

The $T_m$ of dimerized probes (i.e., probes wherein one probe molecule is hybridized to another probe molecule) should ideally be lower than the $T_m$ for the probe hybridized to the target, to ensure that the probes preferentially hybridize to the target sequence at the elevated temperatures at which INVADER assay reactions are generally conducted. Similarly, the $T_m$ for the INVADER oligonucleotide hybridized either to itself or to a probe molecule should be lower than the INVADER oligonucleotide/target $T_m$. It is preferred that dimer $T_m$s (i.e., Probe/Probe and Probe/INVADER oligonucleotide) be 25° C. or less to ensure that they will be unlikely to form at the planned reaction temperature.

The melting temperatures for each of these complexes can be determined as described above in Optimization of Reaction Conditions, I(c) of the Detailed Description of the Invention, or by using the OLIGO software. Once RNAs sites and several candidate INVADER assay oligonucleotide sets are selected according to the process outlined above, the candidate oligonucleotide sets can be ranked according to the degree to which they comply with preferred selection rules, e.g., their location on the SS-Count average plot (peak, valley, neither), and the energetic predictions of probe and INVADER oligonucleotide interactions. In some embodiments, the ranked probe sets are tested in order of rank to identify one or more sets having suitable performance in an RNA INVADER assay. In other embodiments, several of the top ranked sets (e.g., two, three or more) are selected for testing, to rapidly identify one or more sets having suitable or desireable performance.

Mfold Analysis for Probe Structure and Interaction Prediction

Analysis of probe and INVADER oligonucleotide interactions may be performed using mfold for DNA provided by Michael Zuker, available through Rensselaer Polytechnic Institute at bioinfo.math.rpi.edu/~mfold/dna/form1.cgi. The analysis is performed without changing the default ionic conditions, and with a selected temperature of 37° C. and with % suboptimality set to 75. Each sequence (e.g., probe, INVADER oligonucleotide, stacker, etc.) is folded using the program to check for any unimolecular structure formation (e.g., hairpins). The energies provided by mfold gives for unimolecular structures can be used as provided, without further calculations.

Bimolecular structure formation for a given oligonucleotide is assessed by typing in the oligonucleotide sequence (5' to 3') followed by the sequence of a small, stable hairpin forming sequence (e.g., CCCCCTTTTGGGGG [SEQ ID NO:707]), followed by the same oligonucleotide sequence, again listed 5' to 3. Constraints are entered to require that these Ts remain single-stranded and the strings of Cs and Gs in this spacer are basepaired. The command "F" is used to force basepairing, while the command "P" is used to prohibit basepairing, and the positions of the forced or prohibited basepairs are counted from the 5' end. For example, if the sequence of interest is a 20-mer, then the following is entered:

F 21 0 5 [this forces the C's, C21 to C25, to base pair]

P 26 0 4 [this forces the T's, T26 to T29, to be single stranded]

F 30 0 5 [this forces the G's, G30 to G34, to base pair]

On examination of the resulting structures, the stability of each can be estimated by subtracting the stability (i.e., the thermodynamic measures) of the central spacer hairpin from the total result (i.e., Thermodynamics of possible structure=mfold structure thermodynamics−core hairpin thermodynamics). For convenience, in some embodiments, any nearest neighbor interactions between the central hairpin and dimers formed by the test sequence are ignored for this calculation; a more accurate analysis would require consideration of this interaction. The core hairpin formed by CCCCCTTTTGGGGG (SEQ ID NO:707) has the following thermodynamics: ΔG=−5.3; ΔH=−37.8; ΔS=−104.8.

The process can be demonstrated using the following probe sequence: 5'-CCCTATCTTTAAAGTTTT-TAAAAAGTTTGA-3' (SEQ ID NO:708). The oligonucleotide sequence is examined by mfold analysis for bimolecular structures using the following steps.

1—In mfold sequence box type:

(SEQ ID NO:137)
CCCTATCTTTAAAGTTTTTAAAAAGTTTGACCCCCTTTTGGGGGCCC

TATCTTTAAAGTTTTTAAAAAGTTTGA

2—In the constraint box type:

P 36 0 4

F 31 0 5

F 40 0 5

Results (showing one):

```
Structure 1
dG =  -14.2      dH =  -150.5    dS =   -439.5   Tm =  69.3

CCCTATCTTT   G          G         --------      T
         AAA TTTTTAAAAA TTTGA          CCCCC  T
         TTT AAAAATTTTT AAATT          GGGGG  T
--------AG   ^G         G         TCTATCCC      T
```

To evaluate the stability of the duplex:

```
CCCTATCTTT   G           G
         AAA TTTTTAAAAA TTTGA
         TTT AAAAATTTTT AAATT
--------AG   ^G          G    TCTATCCC
``` the thermodyanamic values for the hairpin alone are subtracted from the values for the complete structure:

$\Delta G = -14.2 - (-5.3) = -8.9$, $\Delta H = -150.5 - (-37.8) = -112.7$, $\Delta S = -439.5 - (-104.8) = -334.7$, Using a calculation wherein $T_m$ (° C.)={$\Delta H/[\Delta S+R \ln(CT/4)]$}−273.15, wherein R is the gas constant 1.987 (cal/K.mol), ln is the natural log, and CT is the total single strand concentration in Molar, this results in a calculated $T_m$ of 46.1° C. for the non-hairpin portion of the structure.

The above method is not limited to the use of the core hairpin sequence CCCCCTTTTGGGGG but rather any stable hairpin sequences can be used. For example, CGCGCGGAACGCGCG (SEQ ID NO:138) or CCCGGGTTTTCCCGGG (SEQ ID NO:139). However, if a different hairpin sequence is used, one needs to calculate its stability using mfold and use its thermodynamics in the subsequent calculations.

RNAStructure for Oligonucleotide Interaction Prediction

Dimer formation can also be evaluated using the RNAStructure program. Unlike mfold, RNAStructure allows the calculation of all possible oligonucleotide-oligonucleotide interactions and provides an output .ct file. One can then view the structures using any .ct viewing program such as RNAStructure or RNAvis (1997, P. Rijk, University of Antwerp (UIA), available on the Internet at rrna.uia.ac.be/rnavis) and evaluate the stability of any dimer formation using the nearest-neighbor model (Borer et al., 1974) and DNA nearest-neighbor parameters (Allawi & SantaLucia, 1997).

For example, to evaluate the propensity of the sequence 5' AGGCGCACCAATTTGGTGTT 3' (SEQ ID NO:140) for dimer formation using the DNA Fold Intermolecular module of RNAStructure, the sequence is saved into a file (e.g., probe.seq) and the following parameters are set:
Sequence file 1: probe.seq
Sequence file 2: probe.seq
CT file: dimer.ct
Max % Energy difference: 50
Max number of structures: 20
Window size: do not change After the calculation is done, one can view the resulting .ct file using the "view" module of RNAStructure. Generally, there will be several structures within the .ct file. The view module is used to view them individually. One of the dimers that the test sequece, above, can form according to RNAStructure is:

```
AGGCG                  TT
     CACCAATTTGGTG
     GTGGTTTAACCAC
TT                     GCGGA
```

According to the nearest-neighbor model (i.e., using DNA nearest-neighbor and mismatch parameters [Allawi & SantaLucia, 1997]), the stability of this duplex in 1M NaCl and at a probe concentration of 100 μM is:

$\Delta G°_{37} = -10.07$ $\Delta H = -87.6$ $\Delta S = -250.1$ $Tm = 50.1°$ C.

By changing the identities of Sequence Files 1 & 2, RNAStructure can be used to evaluate the possibility of any dimer formation between pairs of all of the DNA oligonucleotides present in an INVADER assay reaction.

iv. Assay Performance Evaluation

Probe sets selected according to the guidelines provided above can be tested in the INVADER assay to evaluate performance. While the oligonucleotides are designed to perform at or near a particular desired reaction temperature, the best performance for a given design may not be precisely at the intended temperature. Thus, in evaluating any new INVADER assay probe set, it can be helpful to examine the performance in the INVADER assay conducted at several different reaction temperatures, over a range of about 10 to 15° C., centered around the designed temperature. For convenience, temperature optimization can be performed on a temperature gradient thermocycler with a fixed amount of RNA (e.g., 2.5 amoles of an in vitro transcript per reaction), and for a fixed amount of time (e.g., 1 hour each for Primary and Secondary reactions). The temperature gradient test will reveal the temperature at which the designed probe set produces the best performance (e.g., the highest level of target-specific signal compared to background signal, generally expressed as a multiple of the zero-target background signal, or "fold over zero").

The results can be examined to see how close the measured temperature optimum is to the intended temperature of operation. In some embodiments, it is desirable to have probe sets that operate at or near a pre-selected temperature. If the measured temperature optimum is higher than the desired reaction temperature, a probe design can be altered in ways that tend to reduce the probe/target $T_m$ (e.g., shortened by one or more bases, or altered to contain one or more mismatched bases). In some embodiments, wherein a stacker oligonucleotide is not used, wherein the reaction temperature is more than 7° C. above the desired reaction temperature, and wherein the performance (e.g., the fold over zero) is acceptable, use of a 3' mismatch on the probe oligonucleotide is likely to lower the reaction temperature without otherwise altering the assay performance.

An LOD determination can be made by performing reactions on varying amounts of target RNA (e.g., an in vitro transcript control RNA of known concentration). In preferred embodiments, a designed assay has an LOD of less than 0.05 attomole. In particularly preferred embodiments, a designed assay has an LOD of less than 0.01 attomole. It is contemplated that the same guideline provided above for reducing the LOD of a designed assay may be used for the purpose of raising the LOD of a designed assay, i.e., to make it LESS sensitive to the presence of a target RNA. For example, it may be desirable to detect an abundant RNA and a rare RNA in the same reaction. In such a reaction, it may be desirable to attenuate the signal generated for the abundant RNA so that it does not overwhelm the signal from the rarer species. In some embodiments this may be done by designing probe sets for reduced signal generation, e.g., an LOD of at least (not less than) 0.5 attomoles. In some embodiments, a single step INVADER assay may be used for detection of abundant targets in a sample, while sequential INVADER reactions to amplify signal, as described in Section II, may be used for less abundant analytes in the same sample. In preferred embodiments, the single step and the sequential INVADER assay reactions for the different analytes are performed in a single reaction.

In some embodiments, time course reactions are run, wherein the accumulation of signal for a known amount of target is measured for reactions run for different lengths of time. This measurement will establish the linear ranges, i.e., the ranges in which accurate quantitative measurements can be made using a given assay design, with respect to time and starting target RNA level.

V. Design and Assay Optimization

Some designed assays may not meet the preferred performance criteria described above. A number of variations on the performance of INVADER assay reactions have been described herein. In optimizing performance of the INVADER assay for the detection of RNA targets, these variations may be used alone or in combination. For example, in some embodiments, a stacker oligonucleotide is employed. While not limiting the present invention to any particular mechanism of action, in some embodiments, a stacker oligonucleotide may enhance performance of an assay by altering the hybridization characteristics (e.g., $T_m$) of a probe or an INVADER oligonucleotide. In some embodiments, a stacker oligonucleotide may increase performance by enabling the use of a shorter probe. In other embodiments, a stacker oligonucleotide may enhance performance by altering the folded structure of the target nucleic acid. In yet other embodiments, the enhancing activity of the stacker oligonucleotide may involve these and other mechanisms in combination.

In other embodiments, the target site may be shifted. In some embodiments, reactions are optimized by testing multiple probe sets that shift along a suspected accessible site. In preferred embodiments, such probe sets shift along the accessible site in one to two base increments. In embodiments wherein accessible sites have previously been predicted only by computer analysis, physical detection of the accessible sites may be employed to optimize a probe set design. In preferred embodiments, the RT-ROL method of detecting accessible sites is employed. In some embodiments, optimization of a probe set design may require shifting of the target site to a newly identified accessible site.

In some embodiments, e.g., wherein an accessible site has been identified yet probe set performance is low, a change in the design of a probe 5' arm may improve assay performance without altering the site targeted. In other embodiments, altering the length of an ARRESTOR oligonucleotide (e.g., increasing the length of the portion that is complementary to the 5' arm region of the probe) may reduce background signal, thus increasing the probe stet performance.

Other variations on oligonucleotide design may be employed to alter performance in an assay. Some modifications may be employed to shift the ideal operating temperature of a probe set design into a preferred temperature range. For example, the use of shorter oligonucleotides and the incorporation of mismatches generally act to reduce the $T_m$s, and thus reduce the ideal operating temperatures, of designed oligonucleotides. Conversely, the use of longer oligonucleotides and the employment of stacking oligonucleotides generally act to increase the $T_m$s, and thus increase the ideal operating temperatures of the designed oligonucleotides.

Other modifications may be employed to alter other aspects of oligonucleotide performance in an assay. For example, the use of base analogs or modified bases can alter enzyme recognition of the oligonucleotide. In some embodiments, such modified bases are used to protect a region of an oligonucleotide from nuclease cleavage. In other embodiments, modified bases are used to affect the ability of an oligonucleotide to participate as a member of a cleavage structure that is not in a position to be cleaved (e.g., to serve as an INVADER oligonucleotide to enable cleavage of a probe). These modified bases may be referred to as "blocker" or "blocking" modifications. In some embodiments, assay oligonucleotides incorporate 2'-O-methyl modifications. In other embodiments, assay oligonucleotides incorporate 3' terminal modifications (e.g., NH2, 3' hexanol, 3' phosphate, 3' biotin).

In yet other embodiments, the components of the reaction may be altered to affect assay performance. For example, oligonucleotide concentrations may be varied. Oligonucleotide concentrations can affect multiple aspects of the reaction. Since melting temperatures of complexes are partly a function of the concentrations of the components of the complex, variation of the concentrations of the oligonucleotide components can be used as one facet of reaction optimization. In the methods of the present invention, ARRESTOR oligonucleotides may be used to modulate the availability of the primary probe oligonucleotides in an INVADER assay reaction. In some embodiments, an ARRESTOR oligonucleotide may be excluded. Other reaction components may also be varied, including enzyme concentration, salt and divalent ion concentration and identity.

VI. Kits for Performing the RNA INVADER Assay

In some embodiments, the present invention provides kits comprising one or more of the components necessary for practicing the present invention. For example, the present invention provides kits for storing or delivering the enzymes of the present invention and/or the reaction components necessary to practice a cleavage assay (e.g., the INVADER assay). The kit may include any and all components necessary or desired for the enzymes or assays including, but not limited to, the reagents themselves, buffers, control reagents (e.g., tissue samples, positive and negative control target oligonucleotides, etc.), solid supports, labels, written and/or pictorial instructions and product information, inhibitors, labeling and/or detection reagents, package environmental controls (e.g., ice, desiccants, etc.), and the like. In some embodiments, the kits provide a sub-set of the required components, wherein it is expected that the user will supply the remaining components. In some embodiments, the kits comprise two or more separate containers wherein each container houses a subset of the components to be delivered. For example, a first container (e.g., box) may contain an enzyme (e.g., structure specific cleavage enzyme in a suitable storage buffer and container), while a second box may contain oligonucleotides (e.g., INVADER oligonucleotides, probe oligonucleotides, control target oligonucleotides, etc.). In some embodiments one or more the reaction components may be provided in a predispensed format (i.e., premeasured for use in a step of the procedure without re-measurement or re-dispensing). In some embodiments, selected reaction components are mixed and predispensed together. In preferred embodiments, predispensed reaction components are predispensed and are provided in a reaction vessel (including but not limited to a reaction tube or a well, as in, e.g., a microtiter plate). In particularly preferred embodiments, predispensed reaction components are dried down (e.g., desiccated or lyophilized) in a reaction vessel.

Additionally, in some embodiments, the present invention provides methods of delivering kits or reagents to customers for use in the methods of the present invention. The methods of the present invention are not limited to a particular group of customers. Indeed, the methods of the present invention find use in the providing of kits or reagents to customers in many sectors of the biological and medical community, including, but not limited to customers in academic research labs, customers in the biotechnology and medical industries, and customers in governmental labs. The methods of the present invention provide for all aspects of providing the kits or reagents to the customers, including, but not limited to, marketing, sales, delivery, and technical support.

In some embodiments of the present invention, quality control (QC) and/or quality assurance (QA) experiments are conducted prior to delivery of the kits or reagents to customers. Such QC and QA techniques typically involve testing the reagents in experiments similar to the intended commercial uses (e.g., using assays similar to those described herein). Testing may include experiments to determine shelf life of products and their ability to withstand a wide range of solution and/or reaction conditions (e.g., temperature, pH, light, etc.).

In some embodiments of the present invention, the compositions and/or methods of the present invention are disclosed and/or demonstrated to customers prior to sale (e.g., through printed or web-based advertising, demonstrations, etc.) indicating the use or functionality of the present invention or components of the present invention. However, in some embodiments, customers are not informed of the presence or use of one or more components in the product being sold. In such embodiments, sales are developed, for example, through the improved and/or desired function of the product (e.g., kit) rather than through knowledge of why or how it works (i.e., the user need not know the components of kits or reaction mixtures). Thus, the present invention contemplates making kits, reagents, or assays available to users, whether or not the user has knowledge of the components or workings of the system.

Accordingly, in some embodiments, sales and marketing efforts present information about the novel and/or improved properties of the methods and compositions of the present invention. In other embodiments, such mechanistic information is withheld from marketing materials. In some embodiments, customers are surveyed to obtain information about the type of assay components or delivery systems that most suits their needs. Such information is useful in the design of the components of the kit and the design of marketing efforts.

VII. The INVADER Assay for Direct Detection and Measurement of Specific RNA Analytes.

The following section provides a few illustrative examples of mRNAs that may be detected or measured using the methods, compositions and systems of the present invention. Application of the methods and compositions of the present invention is not limited to these target nucleic acid.

Housekeeping Controls

RNAs that are generally present in predicable or invariant amounts in test samples provide useful control targets for detection assays. These controls can be useful in several ways, including but not limited to providing confirmation of the proper function of an assay, and as a standard against which a test result for another RNA can be compared or measured to aid in interpretation of a result. mRNAs for the following genes find particular use in the methods of the present invention.

Human Ubiquitin and Mouse/Rat Ubiquitin

The ubiquitin system is a major pathway for selective protein degradation. Degradation by this system is instrumental in a variety of cellular functions such as DNA repair, cell cycle progression, signal transduction, transcription, and antigen presentation. The ubiquitin pathway also eliminates proteins that are misfolded, misplaced, or that are in other ways abnormal. This pathway requires the covalent attachment of ubiquitin (E1), a highly conserved 76 amino acid protein, to defined lysine residues of substrate proteins.

Human, Rat and Mouse glyceraldehyde-3-phosphate Dehydrogenase (GAPDH)

GAPDH is an important enzyme in the glycolysis and gluconeogenesis pathways. This homotetrameric enzyme catalyzes the oxidative phosphorylation of D-glyceraldehyde-3-phosphate to 1,3-diphosphoglycerate in the presence of cofactor and inorganic phosphate. A variety of diverse biological properties of GAPDH have been reported. These include functions in endocytosis, mRNA regulation, tRNA export, DNA replication, DNA repair, and neuronal apoptosis.

Cytokines

A growing family of regulatory proteins that deliver signals between cells of the immune system has been identified. Called cytokines, these proteins have been found to control the growth and development, and bioactivities, of cells of the hematopoietic and immune systems. Cytokines exhibit a wide range of biological activities with target cells from bone marrow, peripheral blood, fetal liver, and other lymphoid or hematopoietic organs. The present invention describes methods for the detection of expression of cytokines, including but not limited to of the exemplary members of the cytokine family listed below.

Human Oncostatin M

Oncostatin M is a secreted single-chain polypeptide cytokine that regulates the growth of certain tumor-derived and normal cell lines. A number of cell types have been found to bind the oncostatin M protein. While it has been shown to inhibit proliferation of a number of tumor cell types, it has also been implicated in stimulating proliferation of Kaposi's sarcoma cells.

Human Transforming Growth Factor-Beta (TGF-β)

Transforming growth factor-beta (TGF-beta) is a member of a family of structurally-related cytokines that elicit a variety of responses, including growth, differentiation, and morphogenesis, in many different cell types. In vertebrates, at least five different forms of TGF-beta, termed TGF-beta1 to TGF-beta5, have been identified; they all share a high degree (60%–80%) of amino-acid sequence identity. While TGF-beta1 was initially characterized by its ability to induce anchorage-independent growth of normal rat kidney cells, its effects on most cell types are anti-mitogenic. It is strongly growth-inhibitory for many types of cells, including both normal and transformed epithelial, endothelial, fibroblast, neuronal, lymphoid, and hematopoietic cells. In addition, TGF-beta plays a central role in regulating the formation of extracellular matrix and cell-matrix adhesion processes.

Human Monocyte Chemoattractant Protein-1 (MCP-1)

Within this family of cytokines, an emerging group of chemotactic cytokines, also called chemokines or intercrines, has been identified. Two subfamilies of chemokines have been recognized, alpha and beta, based on chromosomal location and the arrangement of the cysteine residues.

The human genes encoding the beta subfamily proteins are located on chromosome 17 (their mouse counterparts are clustered on mouse chromosome 11, which is the counterpart of human chromosome 17). Homology in the beta subfamily ranges from 28–45% intraspecies, from 25–55% interspecies. An exemplary member is the human protein MCP-1 (monocyte chemoattractant protein-1). MCP-1 exerts several effects specifically on monocytes. It is a potent chemoattractant for human monocytes in vitro and can stimulate an increase in cytosolic free calcium and the respiratory burst in monocytes. MCP-1 has been reported to activate monocyte-mediated tumoristatic activity, as well as to induce tumoricidal activity. MCP-1 has been implicated as an important factor in mediating monocytic infiltration of tissues inflammatory processes such as rheumatoid arthritis and alveolitis. The factor may also play a fundamental role in the recruitment of monocyte-macrophages into developing atherosclerotic lesions.

Human Tumor Necrosis Factor Alpha (TNF-α)

Tumor necrosis factor alpha (TNF-alpha also cachectin) is an important cytokine that plays a role in host defense. The cytokine is produced primarily in macrophages and monocytes in response to infection, invasion, injury, or inflammation. Some examples of inducers of TNF-alpha include bacterial endotoxins, bacteria, viruses, lipopolysaccharide (LPS) and cytokines including GM-CSF, IL-1, IL-2 and IFN-gamma.

Despite the protective effects of the cytokine, overexpression of TNF-alpha often results in disease states, particularly in infectious, inflammatory and autoimmune diseases. This process may involve the apoptotic pathways. High levels of plasma TNF-alpha have been found in infectious diseases such as sepsis syndrome, bacterial meningitis, cerebral malaria, and AIDS; autoimmune diseases such as rheumatoid arthritis, inflammatory bowel disease (including Crohn's disease), sarcoidosis, multiple sclerosis, Kawasaki syndrome, graft-versus-host disease and transplant (allograft) rejection; and organ failure conditions such as adult respiratory distress syndrome, congestive heart failure, acute liver failure and myocardial infarction. Other diseases in which TNF-alpha is involved include asthma, brain injury following ischemia, non-insulin-dependent diabetes mellitus, insulin-dependent diabetes mellitus, hepatitis, atopic dermatitis, and pancreatitis. Further, inhibitors of TNF-alpha have been suggested to be useful for cancer prevention. Elevated TNF-alpha expression may also play a role in obesity. TNF-alpha was found to be expressed in human adipocytes and increased expression, in general, correlated with obesity.

Human Interleukin-6 (IL-6)

IL-6 is the standardized name of a cytokine called B lymphocyte differentiating factor, interferon beta2, 26 Kd protein, hybridoma/plasmacytoma growth factor, hepatocyte stimulating factor, etc.

IL-6 induces activated B cells to be differentiated into antibody forming cells. For T cells, IL-6 induces T cells stimulated by mitogens to produce IL-2 and induces the expression of IL-2 receptor on a certain T cell line or thymocytes. For blood forming cells, IL-6 induces the growth of blood forming stem cells synergistically in the presence of IL-3. Furthermore, recently, it was reported that 1L-6 acted like thrombopoietin.

IL-6 is produced by various cells. It is produced by lymphocytes and is also produced by human fibroblasts stimulated by Poly (I)-Poly (C) and cycloheximide. Murine IL-6 is produced in mouse cells, which are stimulated by Poly (A)-Poly (U). Inducers for stimulation are diverse, and include known cytokines such as IL-1, TNF and IFN-beta, growth factors such as PDGF and TGF-beta, LPS, PMA, PHA, cholera toxin, etc. Moreover, it is reported that human vascular endothelial cells, macrophages, human glioblastomas, etc. also produce IL-6. Furthermore, it is also known that the productivity can be further enhanced by stimulating cells using an inducer and subsequently treating the cells by a metabolic inhibitor such as verapamil, cycloheximide or actinomycin D, etc.

Human Interleukin 1Beta (IL-1β)

Interleukin-1 (IL-1) is important to the activation of T and B lymphocytes and mediates many inflammatory processes. Two distinct forms of IL-1 have been isolated and expressed; termed IL-1beta and IL-1alpha. IL-1beta is the predominant form produced by human monocytes both at the mRNA and protein level. The two forms of human IL-1 share only 26% amino acid homology. Despite their distinct polypeptide sequences, the two forms of IL-1 have structural similarities, in that the amino acid homology is confined to discrete regions of the IL-1 molecule. The two forms of IL-1 also possess identical biological properties, including induction of fever, slow wave sleep, and neutrophilia, T- and B-lymphocyte activation, fibroblast proliferation, cytotoxicity for certain cells, induction of collagenases, synthesis of hepatic acute phase proteins, and increased production of colony stimulating factors and collagen. IL-1 also activates endothelial cells, resulting in increased leukocyte adhesiveness, $PGI_2$ and $PGE_2$ (prostaglandins) release, and synthesis of platelet activating factor, procoagulant activity, and a plasminogen activator inhibitor. Clearly, IL-1 plays a central role in local and systemic host responses. Because many of the biological effects of IL-1 are produced at picomolar (pg) concentrations in vivo, IL-1 production is likely a fundamental characteristic of host defense mechanisms.

Human Interleukin 2 (IL-2)

Interleukin-2 (IL-2) is the main growth factor of T lymphocytes. By regulating T helper lymphocyte activity IL-2 increases the humoral and cellular immune responses. By stimulating cytotoxic CD8 T cells and NK cells, this cytokine participates in the defense mechanisms against tumors and viral infections. IL-2 is used in therapy against metastatic melanoma and renal adenocarcinoma. IL-2 is used in clinical trials in many forms of cancer. It is also used in HIV infected patients and leads to a significant increase in CD4 counts. Human IL-2 is a protein of 133 amino acids (aa) composed of four alpha helices connected by loops of various length, its tridimensional structure has been established. IL-2R is composed of three chains alpha, beta and gamma. IL2Ralpha controls the affinity of the receptor IL-2Rbeta and IL-2Rgamma are responsible for IL-2 signal transduction. The different molecular areas of IL-2 interacting with the three chains of the IL-2 R have been defined. More specifically it has been determined that a helix A as well as the NH2 terminal area of IL-2 (residues 1 to 30) control the interactions IL-2/IL-2Rbeta.

Human Interleukin 8 (IL-8)

Human IL-8 is a cytokine that has variously been called neutrophil-activating protein, neutrophil chemotactic factor (NCF) and T-cell chemotactic factor. IL-8 can be secreted by several types of cells upon appropriate stimulation. IL-8 is secreted by activated monocytes and macrophages as well as by embryonic fibroblasts.

IL-8 is known to induce neutrophil migration and to activate functions of neutrophils such as degranulation, release of superoxide anion and adhesion to the endothelial cell monolayer. There are a number of conditions that are known to involve leukocyte infiltration into lesions. These include pulmonary diseases such as pulmonary cystic fibrosis, idiopathic pulmonary fibrosis, adult respiratory distress syndrome, sarcoidosis and empyema; dermal diseases such as psoriasis, rheumatoid arthritis; and inflammatory bowel disease (Crohn's Disease).

The amino acid sequence characterizing human IL-8 was described by Matsushima, et al. in PCT application WO89/08665. More recently, it was shown that monocyte-derived IL-8 was evidently variably processed at the N-terminus and that the IL-8 originally disclosed by Matsushima et al. was accompanied by two forms of the factor which had seven or five additional amino acids at the N-terminus (Yoshimura, et al., Mol Immunol 26:87 [1989]). The longest form accounted for about 8%, the next longest form for about 47%, and the shortest form for about 45% of the total IL-8 derived from monocytes.

Human Interleukin 10 (IL-10)

Interleukin-10 (IL-10), a recently discovered lymphokine, was originally described as an inhibitor of interferon-gamma synthesis and is postulated as a major mediator of the humoral class of immune response. Two classes of often mutually exclusive immune responses are the humoral (antibody-mediated) and the delayed-type hypersensitivity.

It is postulated that these two differing immune responses may arise from two types of helper T-cell clones, namely Th1 and Th2 helper T-cells, which demonstrate distinct cytokine secretion patterns. Mouse Th1 cell clones secrete interferon-gamma, and IL-2 and preferentially induce the delayed-type hypersensitivity response while Th-2 cell clones secrete IL-4, IL-5 and IL-10 and provide support for the humoral responses. The contrast in immune response could result because interferon-gamma secreted by the Th1 cell clones inhibits Th2 clone proliferation in vitro, while IL-10 secreted by the Th2 cell clones inhibits cytokine secretion by the Th1 cell clones. Thus the two T-helper cell types may be mutually inhibitory and may provide the underpinning for the two dissimilar immune responses.

IL-10 has been cloned and sequenced from both murine and human T cells. Both sequences contain an open reading frame encoding a polypeptide of 178 amino acids with an N-terminal hydrophobic leader sequence of 18 amino acids, and have an amino acid sequence homology of 73%.

Human Interleukin 4 (IL-4)

Interleukin-4 (IL-4, also known as B cell stimulating factor, or BSF-1) was originally characterized by its ability to stimulate the proliferation of B cells in response to low concentrations of antibodies directed to surface immunoglobulin. More recently, IL-4 has been shown to possess a far broader spectrum of biological activities, including growth co-stimulation of T cells, mast cells, granulocytes, megakaryocytes, and erythrocytes. In addition, IL-4 stimulates the proliferation of several IL-2- and IL-3-dependent cell lines, induces the expression of class II major histocompatibility complex molecules on resting B cells, and enhances the secretion of IgE and IgG1 isotypes by stimulated B cells. Both murine and human IL-4 have been definitively characterized by recombinant DNA technology and by purification to homogeneity of the natural murine protein.

The biological activities of IL-4 are mediated by specific cell surface receptors for IL-4 that are expressed on primary cells and in vitro cell lines of mammalian origin. IL-4 binds to the receptor, which then transduces a biological signal to various immune effector cells.

Human Interferon Gamma (IFN-γ)

Like the interleukins, interferons belong to the class of the cytokines and are listed in various classes: interferon-alpha, interferon-beta, interferon-gamma, interferon-omega and interferon-tau. Interferon-gamma is a glycoprotein, the amino acid sequence of which has been known since 1982. In the mature condition the interferon-gamma has 143 amino acids and a molecular weight of 63 to 73 kilodaltons.

The tertiary and quaternary structure of the non-glycosylised protein was clarified in 1991. According to this, interferon-gamma exists as a homodimer, the monomers being orientated in contrary directions in such a way that the C-terminal end of one monomer is located in the vicinity of the N-terminal end of the other monomer. Each of these monomers in all has six alpha-helices. Interferon-gamma is also called immunointerferon, as it has non-specific antiviral, antiproliferative and in particular immunomodulatory effects. Its production in T-helper-lymphocytes is stimulated by mitogens and antigens. The effect of the expressed interferon-gamma has not yet been precisely clarified, but is subject to intensive research. In particular, interferon-gamma leads to the activation of macrophages and to the synthesis of histocompatability antigens of the class 2. In vitro, the activity of interferon-gamma is normally determined as a reduction in the virus-induced cytopathic effect, which arises from treatment with interferon-gamma. Due to its antigen-non-specific antiviral, antiproliferative and immunomodulatory activity it is suitable as a human therapeutic agent, for example of kidney tumours and chronic granulomatosis.

Cytochrome P450s

The term cytochrome P-450 refers to a family of enzymes (located on the endoplasmic reticulum, with high concentrations of the proteins in the cells of the liver and small intestine) that are primarily responsible for the metabolism of xenobiotics such as drugs, carcinogens and environmental chemicals, as well as several classes of endobiotics such as steroids and prostaglandins. Members of the cytochrome P450 family are present in varying levels and their expression and activities are controlled by variables such as chemical environment, sex, developmental stage, nutrition and age.

More than 200 cytochrome P450 genes have been identified. There are multiple forms of these P450 genes and each of the individual forms exhibit degrees of specificity towards individual chemicals in the above classes of compounds. In some cases, a substrate, whether it be drug or carcinogen, is metabolized by more then one of the cytochromes P450. Genetic polymorphisms of cytochromes P450 result in phenotypically-distinct subpopulations that differ in their ability to perform biotransformations of particular drugs and other chemical compounds.

The present invention provides methods for the detection cytochrome P450 mRNAs, including but not limited to, Human CYP 1A1, Human CYP 1A2, Human CYP 2B1, Human CYP 2B2, Human CYP 2B6, Human CYP 2C19, Human CYP 2C9, Human CYP 2D6, Human CYP 3A4, Human CYP 3A5, Human CYP 3A7, Rat CYP 2E1, Rat CYP 3A1, Rat CYP 3A2, Rat CYP 4A1, Rat CYP 4A2 and Rat CYP 4A3.

EXAMPLES

The following examples serve to illustrate certain preferred embodiments and aspects of the present invention and are not to be construed as limiting the scope thereof.

In the disclosure which follows, the following abbreviations apply: Afu (*Archaeoglobus fulgidus*); Mth (*Methanobacterium thermoautotrophicum*); Mja (*Methanococcus jannaschii*); Pfu (*Pyrococcus furiosus*); Pwo (*Pyrococcus woesei*); Taq (*Thermus aquaticus*); Taq DNAP, DNAPTaq, and Taq Pol I (*T aquaticus* DNA polymerase I); DNAPStf (the Stoffel fragment of DNAPTaq); DNAPEc1 (*E. coli* DNA polymerase I); Tth (*Thermus thermophilus*); Ex. (Example); Fig. (Figure); ° C. (degrees Centigrade); g (gravitational field); hr (hour); min (minute); olio (oligonucleotide); rxn (reaction); vol (volume); w/v (weight to volume); v/v (volume to volume); BSA (bovine serum albumin); CTAB (cetyltrimethylammonium bromide); HPLC (high pressure liquid chromatography); DNA (deoxyribonucleic acid); p (plasmid); µl (microliters); ml (milliliters); µg (micrograms); mg (milligrams); M (molar); mM (milliMolar); µM (microMolar); pmoles (picomoles); amoles (attomoles); zmoles (zeptomoles); nm (nanometers); kdal (kilodaltons); OD (optical density); EDTA (ethylene diamine tetra-acetic acid); FITC (fluorescein isothiocyanate); SDS (sodium dodecyl sulfate); $NaPO_4$ (sodium phosphate); NP-40 (Nonidet P-40); Tris (tris(hydroxymethyl)-aminomethane); PMSF (phenylmethylsulfonylfluoride); TBE (Tris-Borate-EDTA, i.e., Tris buffer titrated with boric acid rather than HCl and containing EDTA); PBS (phosphate buffered saline); PPBS (phosphate buffered saline containing 1 mM PMSF); PAGE (polyacrylamide gel electrophoresis); Tween (polyoxyethylene-sorbitan); ATCC (American Type Culture Collection, Rockville, Md.); Coriell (Coriell Cell Repositories, Camden, N.J.); DSMZ (Deutsche Sammlung von Mikroorganismen und Zellculturen, Braunschweig, Germany); Ambion (Ambion, Inc., Austin, Tex.); Boehringer (Boehringer Mannheim Biochemical, Indianapolis, Ind.); MJ Research (MJ Research, Watertown, Mass.; Sigma (Sigma Chemical Company, St. Louis, Mo.); Dynal (Dynal A. S., Oslo, Norway); Gull (Gull Laboratories, Salt Lake City, Utah); Epicentre (Epicentre Technologies, Madison, Wis.); Lampire (Biological Labs., Inc., Coopersberg, Pa.); MJ Research (MJ Research, Watertown, Mass.); National Biosciences (National Biosciences, Plymouth, Minn.); NEB (New England Biolabs, Beverly, Mass.); Novagen (Novagen, Inc., Madison, Wis.); Promega (Promega, Corp., Madison, Wis.); Stratagene (Stratagene Cloning Systems, La Jolla, Calif.); Clonetech (Clonetech, Palo Alto, Calif.) Pharmacia (Pharmacia, Piscataway, N.J.); Milton Roy (Milton Roy, Rochester, N.Y.); Amersham (Amersham International, Chicago, Ill.); and USB (U.S. Biochemical, Cleveland, Ohio). Glen Research (Glen Research, Sterling, Va.); Coriell (Coriell Cell Repositories, Camden, N.J.); Gentra (Gentra, Minneapolis, Minn.); Third Wave Technologies (Third Wave Technologies, Madison, Wis.); PerSeptive Biosystems (PerSeptive Biosystems, Framington, Mass.); Microsoft (Microsoft, Redmond, Wash.); Qiagen (Qiagen, Valencia, Calif.); Molecular Probes (Molecular Probes, Eugene, Oreg.); VWR (VWR Scientific,); Advanced Biotechnologies (Advanced Biotechnologies, INC., Columbia, Md.); and Perkin Elmer (also known as PE Biosytems and Applied Biosystems, Foster City, Calif.).

Example 1

Rapid Screening of Colonies for 5' Nuclease Activity

Figure 18C:
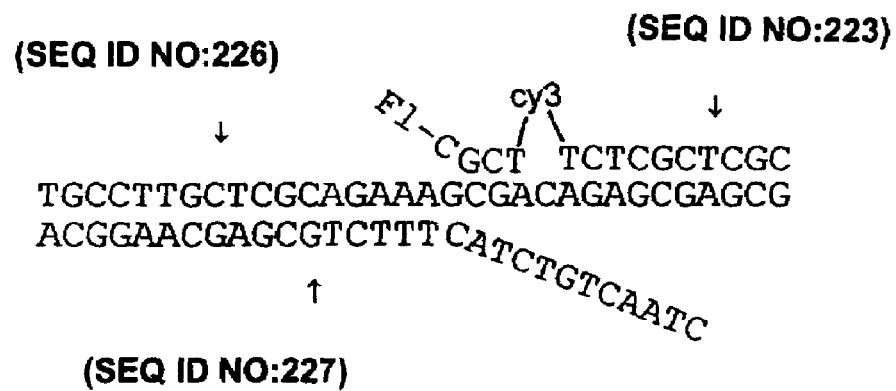

The native 5' nucleases and the enzymes of the present invention can be tested directly for a variety of functions. These include, but are not limited to, 5' nuclease activity on RNA or DNA targets and background specificity using alternative substrates representing structures that may be present in a target detection reaction. Examples of nucleic acid molecules having suitable test structures are shown schematically in FIGS. 18A–D and FIGS. 21–24. The screening techniques described below were developed to quickly and efficiently characterize 5' nucleases and to determine whether the new 5' nucleases have any improved or desired activities. Enzymes that show improved cycling rates on RNA or DNA targets, or that result in reduced target-independent cleavage merit more thorough investigation. In general, the modified proteins developed by random mutagenesis were tested by rapid colony screen on the substrates shown in FIGS. 18A and 18B. A rapid protein extraction was then done, and a test of activity on alternative structures, (e.g., as shown in FIGS. 18C–D) was performed using the protein extract. Either the initial screen, or further screening and characterization of enzymes for improved activity may be performed using other cleavage complexes, such as those diagrammed in FIGS. 21–24. It is not intended that the scope of the invention be limited by the particular sequences used to form such test cleavage structures. One skilled in the art would understand how to design and create comparable nucleic acids to form analogous structures for rapid screening.

This order of testing may be chosen to reduce the number of tests overall, to save time and reagents. The order of testing for enzyme function is not intended to be a limitation on the present invention. Those mutants that showed reasonable cycling rates with the RNA or DNA targets may then be cultured overnight, and a rapid protein extraction done. Alternatively, any subset or all of the cleavage tests may be done at the same time.

For convenience, each type of rapid screen may be done on a separate microtiter plate. For example, one plate may be set up to test RNA INVADER activity, one plate set up to test for DNA INVADER activity. As many as 90 different colonies may be screened on one plate. The colonies screened can be from a variety of sources, such as clones of unaltered (native) 5' nucleases, from one mutagenesis reaction (e.g., many colonies from a single plate) or from a variety of reactions (colonies selected from multiple plates).

Ideally, positive and negative controls should be run on the same plate as the mutants, using the same preparation of reagents. One example of a good positive control is a colony containing the unmodified enzyme, or a previously modified enzyme whose activity is to be compared to new mutants. For example, if a mutagenesis reaction is performed on the Taq DN RX HT construct (described below), the unmodified Taq DN RX HT construct would be chosen as the standard for comparing the effects of mutagenesis on enzymatic activity. Additional control enzymes may also be incorporated into the rapid screening test. For example, Tth DN RX HT (described below; unless otherwise specified, the TaqPol and TthPol enzymes of the following discussion refer to the DN RX HT derivative) may also be included as a standard for enzymatic activity along with the Taq DN RX HT. This would allow a comparison of any altered enzymes to two known enzymes having different activities. A negative control should also be run to determine the background reaction levels (i.e., cleavage or probe degradation due to sources other than the nucleases being compared). A good negative control colony would be one containing only the vector used in the cloning and mutagenesis, for example, colonies containing only the pTrc99A vector.

Two factors that may influence the number of colonies chosen from a specific mutagenesis reaction for the initial rapid screen are 1) total number of colonies obtained from the mutagenesis reaction, and 2) whether the mutagenesis reaction was site-specific or randomly distributed across a whole gene or a region of a gene. For example, if only 5–10 colonies are present on the plate, all colonies can easily be tested. If hundreds of colonies are present, a subset of these may be analyzed. Generally 10–20 colonies are tested from a site-specific mutagenesis reaction, while 80 to 100 or more colonies are routinely tested from a single random mutagenesis reaction.

Where indicated, the altered 5' nucleases described in these experimental examples were tested as detailed below.

A. Rapid Screen: INVADER Activity on RNA Target (FIG. 18A)

A 2× substrate mix was prepared, comprising 20 mM MOPS, pH 7.5, 10 mM MgSO$_4$, 200 mM KCl, 2 µM FRET-probe oligo SEQ ID NO:223 (5'-Fl-CGCT-cy3-TCTCGCTCGC-3'), 1 µM INVADER oligo SEQ ID NO:224 (5'-ACGGAACGAGCGTCTTTG-3'), and 4 nM RNA target SEQ ID NO:225 (5'-GCG AGC GAGA CAG CGA AAG ACG CUC GUU CCG U-3'). Five µl of the 2× substrate mix were dispensed into each sample well of a 96 well microtiter plate (Low Profile MULTIPLATE 96, M.J. Research, Inc.).

Cell suspensions were prepared by picking single colonies (mutants, positive control, and negative control colonies) and suspending each one in 20 µl of water. This can be done conveniently in a 96 well microtiter plate format, using one well per colony.

Five µl of the cell suspension was added to the appropriate test well such that the final reaction conditions were 10 mM MOPS, pH 7.5, 5 mM MgSO$_4$, 100 mM KCl, 1 µM FRET-probe oligo, 0.5 µM INVADER oligo, and 2 nM RNA target. The wells were covered with 10 µl of Clear CHILL-OUT 14 (M.J. Research, Inc.) liquid wax, and the samples were heated at 85° C. for 3 minutes, then incubated at 59° C. for 1 hour. After the incubation, the plates were read on a Cytofluor flourescense plate reader using the following parameters: excitation 485/20, emission 530/30.

B. Rapid Screen: INVADER Activity on DNA Target (FIG. 18B)

A 2× substrate mix was prepared, comprising 20 mM MOPS, pH 7.5, 10 mM MgSO$_4$, 200 mM KCl, 2 µM FRET-probe oligo SEQ ID NO:223 (5'-Fl-CGCT-Cy3-TCTCGCTCGC-3'), 1 µM INVADER oligo SEQ ID NO:224 (5'-ACGGAACGAGCGTCTTTG-3'), 1 nM DNA target SEQ ID NO:226 (5'-GCG AGC GAGA CAG CGA AAG ACG CTC GTT CCG T-3'). Five µl of the 2× substrate mix was dispensed into each sample well of a 96 well microtiter plate (MJ Low Profile).

Cell suspensions were prepared by picking single colonies (mutants, positive control and negative control colonies) and suspending them in 20 µl of water, generally in a 96 well microtiter plate format.

5 µl of the cell suspension were added to the appropriate test well such that the final reaction conditions were 10 mM MOPS, pH 7.5, 5 mM MgSO$_4$, 100 mM KCl, 1 µM FRET-probe oligo, 0.5 µM INVADER oligo, and 0.5 nM DNA target. Wells were covered with 10 µl of Clear CHILL-OUT 14 (M.J. Research, Inc.) liquid wax, and the reactions were heated at 85° C. for 3 minutes, then incubated at 59° C. for 1 hour. After the hour incubation, the plate were read on a Cytofluor flourescan plate reader using the following parameters: excitation 485/20, emission 530/30, gain 40, reads per well 10.

C. Rapid Protein Extraction (Crude Cell Lysate)

Those mutants that gave a positive or an unexpected result in either the RNA or DNA INVADER assay were further analyzed, specifically for background activity on the X-structure or the hairpin substrate (FIGS. 18C and D, respectively). A rapid colony screen format can be employed, as described above. By simply changing the substrate, tests for background or aberrant enzymatic activity can be done. Another approach would be to do a rapid protein extraction from a small overnight culture of positive clones, and then test this crude cell lysate for additional protein function. One possible rapid protein extraction procedure is detailed below. Two to five ml of LB (containing the appropriate antibiotic for plasmid selection; See e.g., Maniatis, books 1,2 and 3) were inoculated with the remaining volume of the 20 µl water-cell suspension and incubated at 37° C. overnight. About 1.4 ml of the culture were transferred to a 1.5 ml microcentrifuge tube, and microcentrifuged at top speed (e.g., 14,000 rpm in an Eppendorf 5417 table top microcentrifuge), at room temperature for 3–5 minutes to pellet the cells. The supernatant was removed, and the cell pellet was suspended in 100 µl of TES buffer pH 7.5 (Sigma). Lysozyme (Promega) was added to a final concentration of 0.5 µg/l and samples were incubated at room temperature for 30 minutes. Samples were then heated at 70° C. for 10 minutes to inactivate the lysozyme, and the cell debris was pelleted by microcentrifugation at top speed for 5 minutes. The supernatant was removed and this crude cell lysate was used in the following enzymatic activity assays.

D. Rapid Screen: Background Specificity X Structure Substrate (FIG. 18C)

Reactions were performed under conditions as detailed above. One µl of crude cell lysate was added to 9 µl of reaction components for a final volume of 10 µl and final concentrations of 10 mM MOPS, pH 7.5, 5 µM MgSO$_4$, 100 mM KCl, 1 µM FRET-probe oligo (SEQ ID NO:223), 0.5 µM X-structure INVADER oligo SEQ ID NO:227 (5'-ACGGAACGAGCGTCTTTCATCTGTCAATC-3'), and 0.5 nM DNA target (SEQ ID NO:226). Wells were covered with 10 µl of Clear CHILLOUT 14 (M.J. Research, Inc.) liquid wax, and the reactions were heated at 85° C. for 3 minutes, then incubated at 59° C. for 1 hour. After the incubation, the plates were read on a Cytofluor fluorescence plate reader using the following parameters: excitation 485/20, emission 530/30, gain 40, reads per well 10.

E. Rapid Screen: Background Specificity Hairpin Substrate (FIG. 18D)

Reactions were performed under conditions as detailed above. One µl of crude cell lysate was added to 9 µl of reaction components for a final volume of 10 µl and final concentrations of 10 mM MOPS, pH 7.5, 5 mM MgSO$_4$, 100 mM KCl, 1 µM FRET-probe oligonucleotide (SEQ ID NO:223), and 0.5 nM DNA target (SEQ ID NO:226). Wells were covered with 10 µl of Clear CHILLOUT 14 (M.J. Research, Inc.) liquid wax, and the reactions were heated at 85° C. for 3 minutes, then incubated at 59° C. for 1 hour. After the hour incubation, the plate were read on a Cytofluor plate reader using the following parameters: excitation 485/20, emission 530/30, gain 40, reads per well 10.

F. Activity Assays with IrT1 and IdT Targets (FIG. 24)

The 5' nuclease activities assays were carried out in 10 µl of a reaction containing 10 mM MOPS, pH 7.5, 0.05% Tween 20, 0.05% Nonidet P-40, 10 µg/ml tRNA, 100 mM KCl and 5 mM MgSO$_4$. The probe concentration (SEQ ID NO: 167) was 2 mM. The substrates (IrT1 (SEQ ID NO: 228) or IdT (SEQ ID NO: 229) at 10 or 1 nM final concentration respectively) and approximately 20 ng of an enzyme, prepared as in Example 3, were mixed with the above reaction buffer and overlaid with CHILLOUT (MJ Research) liquid wax. Reactions were brought up to reaction temperature 57° C., started by addition of MgSO$_4$, and incubated for 10 min. Reactions were then stopped by the addition of 10 µl of 95% formamide containing 10 mM EDTA and 0.02% methyl violet (Sigma). Samples were heated to 90° C. for 1 minute immediately before electrophoresis through a 20% denaturing acrylamide gel (19:1 cross-linked), with 7 M urea, and in a buffer of 45 mM Tris-borate, pH 8.3, 1.4 mM EDTA. Unless otherwise indicated, 1 µl of each stopped reaction was loaded per lane. Gels were then scanned on an FMBIO-100 fluorescent gel scanner (Hitachi) using a 505 nm filter. The fraction of cleaved product was determined from intensities of bands corresponding to uncut and cut substrate with FMBIO Analysis software (version 6.0, Hitachi). The fraction of cleavage product did not exceed 20% to ensure that measurements approximated initial cleavage rates. The turnover rate was defined as the number of cleaved signal probes generated per target molecule per minute under these reaction conditions (1/min).

G. Activity Assays with X Structure (X) and Hairpin (HP) Targets (FIG. 22)

The 5' nuclease activity assays were carried out in 10 µl of a reaction containing 10 mM MOPS, pH 7.5, 0.05% Tween 20, 0.05% Nonidet P-40, 10 µg/ml tRNA, 100 mM KCl and 5 mM MgSO$_4$. Each oligo for formation of either the hairpin structure assembly (22A, SEQ ID NOS: 230 and 231) assembly or the X structure assembly (22B, SEQ ID NOS: 230–232) was added to a final concentration of 1 µm, and approximately 20 ng of test enzyme prepared as described in Example 3, were mixed with the above reaction buffer and overlaid with CHILLOUT (MJ Research) liquid wax. Reactions were brought up to reaction temperature 60° C., started by addition of MgSO$_4$, and incubated for 10 min. Reactions were then stopped by the addition of 10 µl of 95% formamide containing 10 mM EDTA and 0.02% methyl violet (Sigma). Samples were heated to 90° C. for 1 minute immediately before electrophoresis through a 20% denaturing acrylamide gel (19:1 cross-linked), with 7 M urea, and in a buffer of 45 mM Tris-borate, pH 8.3, 1.4 mM EDTA. Unless otherwise indicated, 1 µl of each stopped reaction was loaded per lane. Gels were then scanned on an FMBIO-100 fluorescent gel scanner (Hitachi) using a 505 nm filter. The fraction of cleaved product was determined from intensities of bands corresponding to uncut and cut substrate with FMBIO Analysis software (version 6.0, Hitachi). The fraction of cleavage product did not exceed 20% to ensure that measurements approximated initial cleavage rates. The turnover rate was defined as the number of cleaved signal probes generated per target molecule per minute under these reaction conditions (1/min).

H. Activity Assays with Human IL-6 Target (FIG. 10)

The 5' nuclease activities assays were carried out in 10 µl reactions containing 10 mM MOPS, pH 7.5, 0.05% Tween 20, 0.05% Nonidet P-40, 10 µg/ml tRNA, 100 mM KCl and 5 mM MgSO$_4$. Reactions comprising the DNA IL-6 substrate contained 0.05 nM IL-6 DNA target (SEQ ID NO: 163) and 1 µM of each probe (SEQ ID NO: 162) and INVADER (SEQ ID NO: 161) oligonucleotides, and were carried out at 60° C. for 30 min. Reactions comprising the IL-6 RNA target (SEQ ID NO: 160) were performed under the same conditions, except that the IL-6 RNA target concentration was 1 nM and the reactions were performed at 57° C. for 60 min. Each reaction contained approximately 20 ng of test enzyme, prepared as described in Example 3.

Figure 23:
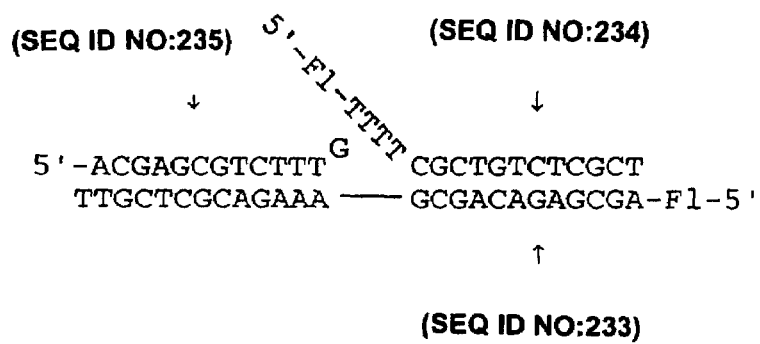
FIG. 23 shows a schematic diagram for a model substrate used to test enzymes for invasive cleavage activity.

I. Activity Assays with Synthetic r25mer Target (FIG. 23)

Reactions comprising the synthetic r25mer target (SEQ ID NO: 233) were carried out under the same reaction conditions (10 mM MOPS, pH 7.5, 0.05% Tween 20, 0.05% Nonidet P-40, 10 µg/ml tRNA, 100 mM KCl and 5 mM MgSO$_4$) and 1 µM of each probe (SEQ ID NO: 234) and INVADER (SEQ ID NO: 235) oligonucleotides, except that the r25mer target concentration was 5 nM and the reactions were performed at 58° C. for 60 min. Approximately 20 ng of each test enzyme was added to the reactions. Enzymes were prepared as described in Example 3.

Any of the tests described above can be modified to derive the optimal conditions for enzymatic activity. For example, enzyme titrations can be done to determine the optimal enzyme concentration for maximum cleavage activity, and lowest background signal. By way of example, but not by way of limitation, many of the mutant enzymes were tested at 10, 20 and 40 ng amounts. Similarly, a temperature titration can also be incorporated into the tests. Since modifying the structure of a protein can alter its temperature requirements, a range of temperatures can be tested to identify the condition best suited for the mutant in question. Additionally, different buffer conditions may be tested. Since modifying the structure of a protein can alter its requirements for salts (e.g., KCl), a range of salt (or other buffer component) concentrations can be tested to identify the conditions best suited for the mutant in question. In some embodiments, enzymes are tested or used in conditions that do not comprise salt added as a buffer component (although some salt may be present from sample preparation or enzyme preparation).

Examples of the results from such screens (using approximately 20 ng of the mutant enzyme) are shown in Tables 3–8, and FIGS. 12, 14, 15, 19, and 25.

Example 2

Cloning and Expression of 5' Nucleases of DNA Polymerases and Mutant Polymerases A. DNA Polymerases of *Thermus aquaticus* and *Thermus thermophilus*

1. Cloning of TaqPol and TthPol

Type A DNA polymerases from eubacteria of the genus *Thermus* share extensive protein sequence identity (90% in the polymerization domain, using the Lipman-Pearson method in the DNA analysis software from DNAStar, Wis.) and behave similarly in both polymerization and nuclease assays. Therefore, the genes for the DNA polymerase of *Thermus aquaticus* (TaqPol), *Thermus thermophilus* (Tth-Pol) and *Thermus scotoductus* were used as representatives of this class. Polymerase genes from other eubacterial organisms, including, but not limited to, *Escherichia coli, Streptococcus pneumoniae, Mycobacterium smegmatis, Thermus thermophilus, Thermus* sp., *Thermotoga maritima, Thermosipho africanus*, and *Bacillus stearothermophilus* are equally suitable.

a. Initial TaqPol Isolation: Mutant TaqA/G

The Taq DNA polymerase gene was amplified by polymerase chain reaction from genomic DNA from *Thermus aquaticus*, strain YT-1 (Lawyer et al, supra), using as primers the oligonucleotides described in SEQ ID NOS:236 and 237. The resulting fragment of DNA has a recognition sequence for the restriction endonuclease EcoRI at the 5' end of the coding sequence and a BglII sequence at the 3' end of the coding strand. Cleavage with BglII leaves a 5' overhang or "sticky end" that is compatible with the end generated by BamHI. The PCR-amplified DNA was digested with EcoRI and BamHI. The 2512 bp fragment containing the coding region for the polymerase gene was gel purified and then ligated into a plasmid that contains an inducible promoter.

In one embodiment of the invention, the pTTQ18 vector, which contains the hybrid trp-lac (tac) promoter, was used (M. J. R. Stark, Gene 5:255 [1987]). The tac promoter is under the control of the *E. coli* lac repressor protein. Repression allows the synthesis of the gene product to be suppressed until the desired level of bacterial growth has been achieved, at which point repression is removed by addition of a specific inducer, isopropyl-b-D-thiogalactopyranoside (IPTG). Such a system allows the controlled expression of foreign proteins that may slow or prevent growth of transformants.

Particularly strong bacterial promoters, such as the synthetic Ptac, may not be adequately suppressed when present on a multiple copy plasmid. If a highly toxic protein is placed under control of such a promoter, the small amount of expression leaking through, even in the absence of an inducer, can be harmful to the bacteria. In another embodiment of the invention, another option for repressing synthesis of a cloned gene product is contemplated. A non-bacterial promoter from bacteriophage T7, found in the plasmid vector series pET-3, was used to express the cloned mutant Taq polymerase genes (Studier and Moffatt, J. Mol. Biol., 189:113 [1986]). This promoter initiates transcription only by T7 RNA polymerase. In a suitable strain, such as BL21 (DE3)pLYS, the gene for the phage T7 RNA polymerase is carried on the bacterial genome under control of the lac operator. This arrangement has the advantage that expression of the multiple copy gene (on the plasmid) is completely dependent on the expression of T7 RNA polymerase, which is easily suppressed because it is present in a single copy.

These are just two examples of vectors having suitable inducible promoters. Others are well known to those skilled in the art, and it is not intended that the improved nucleases of the present invention be limited by the choice of expression system.

For ligation into the pTTQ18 vector, the PCR product DNA containing the Taq polymerase coding region (termed mutTaq for reasons discussed below, SEQ ID NO:238) was digested with EcoRI and BglII and this fragment was ligated under standard "sticky end" conditions (Sambrook et al *Molecular Cloning*, Cold Spring Harbor Laboratory Press, Cold Spring Harbor, pp. 1.63–1.69 [1989]) into the EcoRI and BamHI sites of the plasmid vector pTTQ18. Expression of this construct yields a translational fusion product in which the first two residues of the native protein (Met-Arg) are replaced by three from the vector (Met-Asn-Ser), but the remainder of the PCR product's protein sequence is not changed (SEQ ID NO:239). The construct was transformed into the JM109 strain of *E. coli*, and the transformants were plated under incompletely repressing conditions that do not permit growth of bacteria expressing the native protein. These plating conditions allow the isolation of genes containing pre-existing mutations, such as those that result from the infidelity of Taq polymerase during the amplification process.

Using this amplification/selection protocol, a clone was isolated containing a mutated Taq polymerase gene (mutTaq). The mutant was first detected by its phenotype, in which temperature-stable 5' nuclease activity in a crude cell extract was normal, but polymerization activity was almost absent (approximately less than 1% of wild type Taq polymerase activity). Polymerase activity was determined by primer extension reactions. The reactions were carried out in 10 μl of buffer containing 10 mM MOPS, pH 7.5, 5 mM MgSO$_4$, 100 mM KCl. In each reaction, 40 ng of enzyme were used to extend 10 μM (dT)$_{25-30}$ primer in the preesnce of either 10 μM poly (A)$_{286}$ or 1 μM poly (dA)$_{273}$ template, 45 μM dTTP and 5 μM Fl-dUTP at 60° C. for 30 minutes. Reactions were stopped with 10 μl of stop solution (95% formamide, 10 mM EDTA, 0.02% methyl violet dye). Samples (3 μl) were fractionated on a 15% denaturing acrylamide gel (19:1 crossed-linked) and the fraction of incorporated Fl-dUTP was quantitated using an FMBIO-100 fluorescence gel scanner (Hitachi) equipped with a 505 nm emission filter.

DNA sequence analysis of the recombinant gene showed that it had changes in the polymerase domain resulting in two amino acid substitutions: an A to G change at nucleotide position 1394, which causes a Glu to Gly change at amino acid position 465 (numbered according to the natural nucleic and amino acid sequences, SEQ ID NOS:153 and 157), and another A to G change at nucleotide position 2260, which causes a Gln to Arg change at amino acid position 754. Because the Gln to Gly mutation is at a nonconserved position and because the Glu to Arg mutation alters an amino acid that is conserved in virtually all of the known Type A polymerases, the latter mutation is most likely the one responsible for curtailing the synthesis activity of this protein. The nucleotide sequence for the construct is given in SEQ ID NO:39. The enzyme encoded by this sequence is referred to as Taq A/G.

b. Initial TthPol Isolation

The DNA polymerase enzyme from the bacterial species *Thermus thermophilus* (Tth) was produced by cloning the gene for this protein into an expression vector and overproducing it in *E. coli* cells. Genomic DNA was prepared from 1 vial of dried *Thermus thermophilus* strain HB-8 from ATCC (ATCC #27634). The DNA polymerase gene was amplified by PCR using the following primers: 5'-CAC-GAATTCCGAGGCGATGCTTCCGCTC-3' (SEQ ID NO:240) and 5'-TCGACGTCGACTAACCCTTGGCG-GAAAGCC-3' (SEQ ID NO:241). The resulting PCR product was digested with EcoRI and SalI restriction endonucleases and inserted into EcoRI/Sal I digested plasmid vector pTrc99G (described in Example 2C1) to create the plasmid pTrcTth-1. This Tth polymerase construct is missing a single nucleotide that was inadvertently omitted from the 5' oligonucleotide, resulting in the polymerase gene being out of frame. This mistake was corrected by site specific mutagenesis of pTrcTth-1 as described in Examples 4 and 5 using the following oligonucleotide: 5'-GCATCGC-CTCGGAATTCATGGTC-3' (SEQ ID NO:242), to create the plasmid pTrcTth-2. The protein and the nucleic acid sequence encoding the protein are referred to as TthPol, and are listed as SEQ ID NOS:243 and 244 respectively.

C. Large Scale Preparation of Recombinant Proteins

The recombinant proteins were purified by the following technique which is derived from a Taq DNA polymerase preparation protocol (Engelke et al., Anal. Biochem., 191: 396 [1990]) as follows. *E. coli* cells (strain JM109) containing either pTrc99A TaqPol, pTrc99GThPol were inoculated into 3 ml of LB containing 100 mg/ml ampicillin and grown for 16 hrs at 37° C. The entire overnight culture was inoculated into 200 ml or 350 ml of LB containing 100 mg/ml ampicillin and grown at 37° C. with vigorous shaking to an $A_{600}$ of 0.8. IPTG (1 M stock solution) was added to a final concentration of 1 mM and growth was continued for 16 hrs at 37° C.

The induced cells were pelleted and the cell pellet was weighed. An equal volume of 2×DG buffer (100 mM Tris-HCl, pH 7.6, 0.1 mM EDTA) was added and the pellet was suspended by agitation. Fifty mg/ml lysozyme (Sigma) were added to 1 mg/ml final concentration and the cells incubated at room temperature for 15 min. Deoxycholic acid (10% solution) was added dropwise to a final concentration of 0.2% while vortexing. One volume of $H_2O$ and 1 volume of 2×DG buffer were added, and the resulting mixture was sonicated for 2 minutes on ice to reduce the viscosity of the mixture. After sonication, 3 M $(NH_4)_2SO_4$ was added to a final concentration of 0.2 M, and the lysate was centrifuged at 14000×g for 20 min at 4° C. The supernatant was removed and incubated at 70° C. for 60 min at which time 10% polyethylimine (PEI) was added to 0.25%. After incubation on ice for 30 min., the mixture was centrifuged at 14,000×g for 20 min at 4° C. At this point, the supernatant was removed and the protein precipitated by the addition of $(NH_4)_2SO_4$ as follows.

Two volumes of 3 M $(NH_4)_2SO_4$ were added to precipitate the protein. The mixture was incubated overnight at room temperature for 16 hrs centrifuged at 14,000×g for 20 min at 4° C. The protein pellet was suspended in 0.5 ml of Q buffer (50 mM Tris-HCl, pH 8.0, 0.1 mM EDTA, 0.1% Tween 20). For the Mja FEN-1 preparation, solid $(NH_4)_2SO_4$ was added to a final concentration of 3 M (~75% saturated), the mixture was incubated on ice for 30 min, and the protein was spun down and suspended as described above.

The suspended protein preparations were quantitated by determination of the $A_{279}$ dialyzed and stored in 50% glycerol, 20 mM Tris HCl, pH 8.0, 50 mM KCl, 0.5% Tween 20, 0.5% Nonidet P-40, with 100 µg/ml BSA.

B. DNA polymerases of *Thermus filiformis* and *Thermus scotoductus*

1. Cloning of *Thermus filiformis* and *Thermus scotoductus*

One vial of lyophilized *Thermus filiformis* (Tfi) obtained from DSMZ (Deutsche Sammlung von Mikroorganismen und Zellculturen, Braunschweig, Germany, strain #4687) was rehydrated in 1 ml of Castenholz medium (DSMZ medium 86) and inoculated into 500 ml of Castenholz medium preheated to 50° C. The culture was incubated at 70° C. with vigorous shaking for 48 hours. After growth, the cells were harvested by centrifugation at 8000×g for 10 minutes, the cell pellet was suspended in 10 ml of TE (10 mM Tris HCL, pH 8.0, 1 mM EDTA), and the cells were frozen at −20° C. in 1 ml aliquots. A 1 ml aliquot was thawed, lysozyme was added to 1 mg/ml, and the cells were incubated at 23° C. for 30 minutes. A solution of 20% SDS (sodium dodecyl sulfate) was added to a final concentration of 0.5% followed by extraction with buffered phenol. The aqueous phase was further extracted with 1:1 phenol:chloroform, and extracted a final time with chloroform. One-tenth volume of 3 M sodium acetate, pH 5.0 and 2.5 volumes of ethanol were added to the aqueous phase and mixed. The DNA was pelleted by centrifugation at 20,000×g for 5 minutes. The DNA pellet was washed with 70% ethanol, air dried and resuspended in 200 µl of TE and used directly for amplification. *Thermus scotoductus* (Tsc, ATCC # 51532) was grown and genomic DNA was prepared as described above for *Thermus filiformis*.

The DNA polymerase I gene from Tfi (GenBank accession #AF030320) could not be amplified as a single fragment. Therefore, it was cloned in 2 separate fragments into the expression vector pTrc99a. The 2 fragments overlap and share a Not I site which was created by introducing a silent mutation at position 1308 of the Tfi DNA polymerase open reading frame (ORF) in the PCR oligonucleotides. The 3' half of the gene was amplified using the Advantage cDNA PCR kit (Clonetech) with the following oligonucleotides; 5'-ATAGCCATGGTGGAGCGGCCGCTCTCCCGG (SEQ ID NO:245) and 5'-AAGCGTCGACTCAATCCTGCT-TCGCCTCCAGCC (SEQ ID NO:246). The PCR product from this reaction was approximately 1200 base pairs in length. It was cut with the restriction enzymes Not I and Sal I, and the resulting DNA was ligated into pTrc99a cut with NotI and SalI to create pTrc99a-Tfi3'. The 5' half of the gene was amplified as described above using the following two primers; 5'AATCGAATTCACCCCACTTTTTGACCTG-GAGG (SEQ ID NO:247) and 5'-CCGGGAGAGCGGC-CGCTCCAC (SEQ ID NO:248). The resulting 1300 base pair fragment was cut with restriction enzymes Eco RI and Not I and ligated into pTrc99a-Tfi3' cut with NotI and EcoRI to produce pTrc99a-TfiPol, SEQ ID NO:249 (the corresponding amino acid sequence is listed in SEQ ID NO:250).

The DNA polymerase I gene from *Thermus scotoductus* was amplified using the Advantage cDNA PCR kit (Clonetech) using the following two primers; 5'-ACTG-GAATTCCTGCCCCTCTTTGAGCCCAAG (SEQ ID NO:251) and 5'-AACAGTCGACCTAGGCCTTGGCG-GAAAGCC (SEQ ID NO:252). The PCR product was cut with restriction enzymes Eco RI and Sal I and ligated into Eco RI, Sal I cut pTrc99a to create pTrc99a-TscPol SEQ ID NO:253 (the corresponding amino acid sequence is listed in SEQ ID NO:254).

2. Expression and Purification of *Thermus filiformis* and *Thermus scotoductus*

Plasmids were transformed into protease deficient *E. coli* strain BL21 (Novagen) or strain JM109 (Promega Corp., Madison, Wis.) for protein expression. Flasks containing 200 ml of LB containing 100 μg/ml ampicillin were inoculated with either a single colony from an LB plate or from a frozen stock of the appropriate strain. After several hours of growth at 37° C. with vigorous shaking, cultures was induced by the addition of 200 μl of 1 M isothiopropyl-galatoside (IPTG). Growth at 37° C. was continued for 16 hours prior to harvest. Cells were pelleted by centrifugation at 8000×g for 15 minutes followed by suspension of the cell pellet in 5 ml of TEN (10 mM Tris HCl, pH 8.0, 1 mM EDTA, 100 mM NaCl). 100 μl of 50 mg/ml lysozyme were added and the cells incubated at room temperature for 15 minutes. Deoxycholic acid (10%) was added to a final concentration of 0.2%. After thorough mixing, the cell lysates were sonicated for 2 minutes on ice to reduce the viscosity of the mixture. Cellular debris was pelleted by centrifugation at 4° C. for 15 minutes at 20,000×g. The supernatant was removed and incubated at 70° C. for 30 min after which 10% polyethylimine (PEI) was added to 0.25%. After incubation on ice for 30 minutes, the mixture was centrifuged at 20,000×g for 20 min at 4° C. At this point, the supernatant containing the enzyme was removed, and the protein was precipitated by the addition of 1.2 g of ammonium sulfate and incubation at 4° C. for 1 hour. The protein was pelleted by centrifugation at 4° C. for 10 minutes at 20,000×g. The pellet was resuspended in 4 ml of HPLC Buffer A (50 mM Tris HCl, pH 8.0, 1 mM EDTA). The protein was further purified by affinity chromatography using an Econo-Pac heparin cartridge (Bio-Rad) and a Dionex DX 500 HPLC instrument. Briefly, the cartridge was equilibrated with HPLC Buffer A, and the enzyme extract was loaded on the column and eluted with a linear gradient of NaCl (0–2 M) in the same buffer. Pure protein elutes between 0.5 and 1 M NaCl. The enzyme peak was collected and dialyzed in 50% glycerol, 20 mM Tris HCl, pH 8, 50 mM KCl, 0.5% Tween 20, 0.5% Nonidet P40, 100 mg/ml BSA.

C. Generation of Polymerase Mutants with Reduced Polymerase Activity but Unaltered 5' Nuclease Activity All mutants generated in section C were expressed and purified as described in Example 2A1C.

1. Modified TaqPol Genes: TaqDN

A polymerization deficient mutant of Taq DNA polymerase called TaqDN was constructed. TaqDN nuclease contains an asparagine residue in place of the wild-type aspartic acid residue at position 785 (D785N).

DNA encoding the TaqDN nuclease was constructed from the gene encoding the Taq A/G in two rounds of site-directed mutagenesis. First, the G at position 1397 and the G at position 2264 of the Taq A/G gene (SEQ ID NO:238) were changed to A at each position to recreate a wild-type TaqPol gene. In a second round of mutagenesis, the wild type TaqPol gene was converted to the Taq DN gene by changing the G at position 2356 to A. These manipulations were performed as follows.

DNA encoding the Taq A/G nuclease was recloned from pTTQ18 plasmid into the pTrc99A plasmid (Pharmacia) in a two-step procedure. First, the pTrc99A vector was modified by removing the G at position 270 of the pTrc99A map, creating the pTrc99G cloning vector. To this end, pTrc99A plasmid DNA was cut with NcoI and the recessive 3' ends were filled-in using the Klenow fragment of *E. coli* polymerase I in the presence of all four dNTPs at 37° C. for 15 min. After inactivation of the Klenow fragment by incubation at 65° C. for 10 min, the plasmid DNA was cut with EcoRI and the ends were again filled-in using the Klenow fragment in the presence of all four dNTPs at 37° C. for 15 min. The Klenow fragment was then inactivated by incubation at 65° C. for 10 min. The plasmid DNA was ethanol precipitated, recircularized by ligation, and used to transform *E.coli* JM109 cells (Promega). Plasmid DNA was isolated from single colonies, and deletion of the G at position 270 of the pTrc99A map was confirmed by DNA sequencing.

In a second step, DNA encoding the Taq A/G nuclease was removed from the pTTQ18 plasmid using EcoRI and SalI and the DNA fragment carrying the Taq A/G nuclease gene was separated on a 1% agarose gel and isolated with Geneclean II Kit (Bio 101, Vista, Calif.). The purified fragment was ligated into the pTrc99G vector that had been cut with EcoRI and SalI. The ligation mixture was used to transform competent *E. coli* JM109 cells (Promega). Plasmid DNA was isolated from single colonies and insertion of the Taq A/G nuclease gene was confirmed by restriction analysis using EcoRI and SalI.

Plasmid DNA pTrcAG carrying the Taq A/G nuclease gene cloned into the pTrc99A vector was purified from 200 ml of JM109 overnight culture using QIAGEN Plasmid Maxi kit (QIAGEN, Chatsworth, Calif.) according to manufacturer's protocol. pTrcAG plasmid DNA was mutagenized using two mutagenic primers, E465 (SEQ ID NO:255) (Integrated DNA Technologies, Iowa) and R754Q (SEQ ID NO:256) (Integrated DNA Technologies), and the selection primer Trans Oligonucleotide AlwNI/SpeI (Clontech, Palo Alto, Calif., catalog #6488-1) according to TRANS-FORMER Site-Directed Mutagenesis Kit protocol (Clontech, Palo Alto, Calif.) to produce a restored wild-type TaqPol gene (pTrcWT).

pTrcWT plasmid DNA carrying the wild-type TaqPol gene cloned into the pTrc99A vector was purified from 200 ml of JM109 overnight culture using QIAGEN Plasmid Maxi kit (QIAGEN, Chatsworth, Calif.) according to manufacturer's protocol. pTrcWT was then mutagenized using the mutagenic primer D785N (SEQ ID NO:257) (Integrated DNA Technologies) and the selection primer Switch Oligonucleotide SpeI/AlwNI (Clontech, Palo Alto, Calif., catalog #6373-1) according to TRANSFORMER Site-Directed Mutagenesis Kit protocol (Clontech, Palo Alto, Calif.) to create a plasmid containing DNA encoding the Taq DN nuclease. The DNA sequence encoding the Taq DN nuclease is provided in SEQ ID NO:258; the amino acid sequence of Taq DN nuclease is provided in SEQ ID NO:259.

2. Modified TthPol Gene: Tth DN

The Tth DN construct was created by mutating the TthPol described above. The sequence encoding an aspartic acid at position 787 was changed by site-specific mutagenesis as described above to a sequence encoding asparagine. Mutagenesis of pTrcTth-2 with the following oligonucleotide: 5'-CAGGAGGAGCTCGTTGTGGACCTGGA-3' (SEQ ID NO:260) was performed to create the plasmid pTrcTthDN. The mutant protein and protein coding nucleic acid sequence is termed TthDN SEQ ID NOS:261 and 262 respectively.

3. Taq DN HT and Tth DN HT

Six amino acid histidine tags (his-tags) were added onto the carboxy termini of Taq DN and Tth DN. The site-directed mutagenesis was performed using the TRANS-FORMER Site Directed Mutagenesis Kit (Clontech) according to the manufacturer's instructions. The mutagenic oligonucleotides used on the plasmids pTaq DN and pTth DN were sequence 117-067-03, 5'-TCTAGAGGATCTAT-CAGTGGTGGTGGTGGTGGTGCTCCTTG-GCGGAGAGC-3' (SEQ ID NO:263) and 5'-TGCCTG-CAGGTCGACGCTAGCTAGTGGTGGTGGTGGTGGTGAGCCTTGCCG-GAAAGCC-3' (SEQ ID NO:264), sequence 136-037-05. The selection primer Trans Oligo AlwNI/SpeI (Clontech, catalog # 6488-1) was used for both mutagenesis reactions. The resulting mutant genes were termed Taq DN HT (SEQ ID NO:265, nucleic acid sequence; SEQ ID NO:266, amino acid sequence) and Tth DN HT (SEQ ID NO:267, nucleic acid sequence; SEQ ID NO:268, amino acid sequence).

4. Purification of Taq DN HT and Tth DN HT

Both Taq DN HT and Tth DN HT proteins were expressed in E. coli strain JM109 as described in Example 2B2. After ammonium sulfate precipitation and centrifugation, the protein pellet was suspended in 0.5 ml of Q buffer (50 mM Tris-HCl, pH 8.0, 0.1 mM EDTAm 0.1% Tween 20). The protein was further purified by affinity chromatography using His-Bind Resin and Buffer Kit (Novagen) according to the manufacturer's instructions. 1 ml of His-Bind resin was transferred into a column, washed with 3 column volumes of sterile water, charged with 5 volumes of 1× Charge Buffer, and equilibrated with 3 volumes of 1× Binding Buffer. Four ml of 1× Binding Buffer was added to the protein sample and the sample solution was loaded onto the column. After washing with 3 ml of 1× Binding Buffer and 3 ml of 1× Wash Buffer, the bound His-Tag protein was eluted with 1 ml of 1× Elute Buffer. The pure enzyme was then dialyzed in 50% glycerol, 20 mM Tris-HCl, pH 8.0, 50 mM KCl, 0.5% Tween 20, 0.5% Nonidet P40, and 100 μg.ml BSA. Enzyme concentrations were determined by measuring absorption at 279 nm.

Example 3

RNA-Dependent 5' Nuclease Activity of TthPol can be Conferred on TaqPol by Transfer of the N-Terminal Portion of the DNA Polymerase Domain A. Preparation and Purification of Substrate Structures Having Either a DNA or an RNA Target Strand The downstream (SEQ ID NO:162) and upstream probes (SEQ ID NO:161) and the IL-6 DNA (SEQ ID NO:163) (FIG. 10) target strand were synthesized on a PerSeptive Biosystems instrument using standard phosphoramidite chemistry (Glen Research). The synthetic RNA-DNA chimeric IrT target labeled with biotin at the 5'-end (FIG. 20A) was synthesized utilizing 2'-ACE RNA chemistry (Dharmacon Research). The 2'-protecting groups were removed by acid-catalyzed hydrolysis according to the manufacturer's instructions. The downstream probes labeled with 5'-fluorescein (Fl) or 5'-tetrachloro-fluorescein (TET) at their 5' ends were purified by reverse phase HPLC using a Resource Q column (Amersham-Pharmacia Biotech). The 648-nucleotide IL-6 RNA target (SEQ ID NO:160) (FIG. 10) was synthesized by T7 RNA polymerase runoff-transcription of the cloned fragment of human IL-6 cDNA (nucleotides 64–691 of the sequence published in May et al., Proc. Natl. Acad. Sci., 83:8957 [1986]) using a Megascript Kit (Ambion). All oligonucleotides were finally purified by separation on a 20% denaturing polyacrylamide gel followed by excision and elution of the major band. Oligonucleotide concentration was determined by measuring absorption at 260 nm. The biotin labeled IrT target was incubated with a 5-fold excess of streptavidin (Promega) in a buffer containing 10 mM MOPS, pH 7.5, 0.05% Tween 20, 0.05% NP-40 and 10 μg/ml tRNA at room temperature for 10 min.

B. Introduction of Restriction Sites to Make Chimeras

The restriction sites used for formation of chimerical proteins, described below, were chosen for convenience. The restriction sites in the following example have been strategically placed to surround regions shown by crystal structure and other analysis to be functional domains (See, FIGS. 6, 7, and 19). Different sites, either naturally occurring or created via directed mutagenesis can be used to make similar constructs with other Type A polymerase genes from related organisms. It is desirable that the mutations all be silent with respect to protein function. By studying the nucleic acid sequence and the amino acid sequence of the protein, one can introduce changes in the nucleic acid sequence that have no effect on the corresponding amino acid sequence. If the nucleic acid change required affects an amino acid, one can make the alteration such that the new amino acid has the same or similar characteristics of the one replaced. If neither of these options is possible, one can test the mutant enzyme for function to determine if the nucleic acid alteration caused a change in protein activity, specificity or function. It is not intended that the invention be limited by the particular restriction sites selected or introduced for the creation of the improved enzymes of the present invention.

C. Generation of Tth DN RX HT and Taq DN RX HT

Mutagenesis was performed to introduce 3 additional, unique restriction sites into the polymerase domain of both the Taq DN HT and Tth DN HT enzymes. Site-specific mutagenesis was performed using the Transformer Site-Directed Mutagenesis Kit from (Clonetech) according to manufacturer's instructions. One of two different selection primers, Trans Oligo AlwNI/SpeI or Switch Oligo SpeI/AlwNI (Clontech, Palo Alto Calif. catalog #6488-1 or catalog #6373-1) was used for all mutagenesis reactions described. The selection oligo used in a given reaction is dependent on the selection restriction site present in the vector. All mutagenic primers were synthesized by standard synthetic chemistry. Resultant colonies were expressed in E. coli strain JM 109.

The Not I sites (amino acid position 328) were created using the mutagenic primers 5'-gccgccaggggcggccgcgtccac-cgggcc (SEQ ID NO:269) and 5'-gcctgcaggggcggccgcgtg-caccgggcca (SEQ ID NO:270) corresponding to the sense strands of the Taq DN HT and the Tth DN HT genes, respectively. The BstI (amino acid position 382) and NdeI (amino acid position 443) sites were introduced into both genes using sense strand mutagenic primes 5'-ctcctggaccct-tcgaacaccacccc (SEQ ID NO:271) and 5'-gtcctggcccatatg-gaggccac (SEQ ID NO:272). The mutant plasmids were over-expressed and purified using Qiagen QiaPrep Spin Mini Prep Kit (cat. # 27106). The vectors were tested for the presence of the restriction sites by DNA sequencing and restriction mapping. These constructs are termed Tth DN RX HT (DNA sequence SEQ ID NO:273; amino acid sequence SEQ ID NO:274) and Taq DN RX HT (DNA sequence SEQ ID NO:275; amino acid sequence SEQ ID NO:276).

D. Chimeras

The chimeric constructs shown in FIG. 19 were created by exchanging homologous DNA fragments defined by the restriction endonuclease sites EcoRI(E) and BamHI (B), common for both genes, the cloning vector site SalI(S) and the new sites, NotI(N), BstBI(Bs), NdeI(D) created at the homologous positions of both genes by site directed mutagenesis. In generating these chimeric enzymes, two different pieces of DNA are ligated together to yield the final construct. The larger piece of DNA that contains the plasmid vector as well as part of the Taq or Tth (or parts of both) sequence will be termed the "vector." The smaller piece of DNA that contains sequences of either the Taq or Tth (or parts of both) polymerase will be termed the "insert."

All restriction enzymes were from New England Biolabs or Promega and used in reactions with the accompanying buffer, according to the manufacturer's instructions. Reactions were done in 20 µl volume with about 500 ng of DNA per reaction, at the optimal temperature for the specified enzyme. More than one enzyme was used in a single reaction (double digest) if the enzymes were compatible with respect to reaction buffer conditions and reaction temperature. If the enzymes in question were not compatible with respect to buffer conditions, the enzyme requiring the lowest salt condition was used first. After the completion of that reaction, buffer conditions were changed to be optimal or better suited to the second enzyme, and the second reaction was performed. These are common restriction enzyme digest strategies, well known to those in the art of basic molecular biology (Maniatis, supra).

The digested restriction fragments were gel isolated for optimal ligation efficiency. Two µl of 10× loading dye (50% glycerol, 1×TAE, 0.5% bromophenol blue) were added to the 20 µl reaction. The entire volume was loaded and run on a 1%, 1×TAE agarose gel containing 1 µl of a 1% ethidium bromide solution per 100 ml of agarose gel solution. The digested fragments were visualized under UV light, and the appropriate fragments (as determined by size) were excised from the gel. These fragments were then purified using the Qiagen Gel Extractio Kit, (cat # 28706) according to the manufacturer's instructions.

Ligations were performed in a 10 µl volume, using 400 units per reaction of T4 DNA Ligase enzyme from New England Biolabs (catalog #202L), with the accompanying reaction buffer. Ligation reactions were done at room temperature for 1 hour, with 1 µl of each of the Qiagen-purified fragments (approximately 20–50 ng of each DNA, depending on recovery from the gel isolation). Ligation products were then transformed into *E. coli* strain JM 109 and plated onto an appropriate growth and selection medium, such as LB with 100 µg/ml of ampicillin to select for transformants.

For each ligation reaction, six transformants were tested to determine if the desired construct was present. Plasmid DNA was purified and isolated using the QiaPrep Spin Mini Prep Kit, according to manufacturer's instructions. The constructs were verified by DNA sequencing and by restriction mapping.

Expression and purification of the chimeric enzymes was done as follows. Plasmids were transformed into *E. coli* strain JM109 (Promega). Log phase cultures (200 ml) of JM109 were induced with 0.5 mM IPTG (Promega) and grown for an additional 16 hours prior to harvest. Crude extracts containing soluble proteins were prepared by lysis of pelleted cells in 5 ml of 10 mM Tris-HCl, pH 8.3, 1 mM EDTA, 0.5 mg/ml lysozyme during incubation at room temperature for 15 minutes. The lysate was mixed with 5 ml of 10 mM Tris-HCl pH 7.8, 50 mM KCl, 1 mM EDTA, 0.5% Tween 20, 0.5% Nonidet P-40, heated at 72° C. for 30 minutes, and cell debris was removed by centrifugation at 12,000×g for 5 minutes. Final purification of the protein was done by affinity chromatography using an Econo-Pac heparin cartridge (Bio-Rad) and Dionex DX 500 HPLC instrument. Briefly, the cartridge was equilibrated with 50 mM Tris-HCl pH 8, 1 mM EDTA, and an enzyme extract dialyzed against the same buffer was loaded on the column and eluted with a linear gradient of NaCl (0–2 M) in the same buffer. The HPLC-purified protein was dialyzed and stored in 50% (vol/vol) glycerol, 20 mM Tris-HCl pH 8.0, 50 mM KCl, 0.5% Tween 20, 0.5% Nonidet P-40, and 100 µg/m BSA. The enzymes were purified to homogeneity according to SDS-PAGE, and the enzyme concentrations were determined by measuring absorption at 279 nm.

1. Construction of TaqTth(N) and TthTaq(N)

The first exchange that was performed involved the polymerase domains of the two enzymes. Separation of the nuclease domain (the N-terminal end of the protein) from the polymerase domain (the C-terminal portion of the protein) was accomplished by cutting both genes with the restriction endonucleases EcoRI and NotI. The approximately 900 base pair fragment from the Tth DN RX HT gene was cloned into the homologous sites of the Taq DN RX HT gene, and the approximately 900 base pair fragment from the Taq DN RX HT gene was cloned into the homologous sites of the Tth DN RX HT gene, yielding two chimeras, TaqTth (N)(DNA sequence SEQ ID NO:69; amino acid sequence SEQ ID NO:2) which has the Taq DN RX HT 5' nuclease domain and the Tth DN RX HT polymerase domain, and TthTaq(N) (DNA sequence SEQ ID NO:70; amino acid sequence SEQ ID NO:3) which is made up of the Tth DN RX HT 5' nuclease domain and the Taq DN RX HT polymerase domain.

2. Construction of TaqTth(N-B)

The Taq DN RX HT construct was cut with the enzymes NdeI and BamHI and the larger, vector fragment was gel isolated as detailed above. The Tth DN RX HT construct was also cut with NdeI and BamHI and the smaller (approximately 795 base pairs) Tth fragment was gel isolated and purified. The Tth NdeI-BamHI insert was ligated into the Taq NdeI-BamHI vector as detailed above to generate the TaqTth(N-B) (DNA sequence SEQ ID NO:71; amino acid sequence SEQ ID NO:4).

3. Construction of TaqTth(B-S)

The Taq DN RX HT construct was cut with the enzymes BamHI and SalI and the larger vector fragment was gel isolated as detailed above. The Tth DN RX HT construct was also cut with BamHI and SalI and the smaller (approximately 741 base pairs) Tth fragment was gel isolated and purified. The Tth BamHI-SalI insert was ligated into the Taq BamHI-SalI vector as detailed above to generate the TaqTth (B-S)(DNA sequence SEQ ID NO:72; amino acid sequence SEQ ID NO:5).

4. Construction of TaqTth(N-D)

The Taq DN RX HT construct was cut with the enzymes NotI and NdeI and the larger vector fragment was isolated as detailed above. The Tth DN RX HT construct was also cut with NotI and NdeI and the smaller (approximately 345 base pairs) Tth fragment was gel isolated and purified. The Tth NotI-NdeI insert was ligated into the Taq NotI-NdeI vector as detailed above to generate the TaqTth(N-D) (DNA sequence SEQ ID NO:73; amino acid sequence SEQ ID NO:6).

5. Construction of TaqTth(D-B)

The Taq DN RX HT construct was cut with the enzymes NdeI and BamHI and the larger vector fragment was isolated as detailed above. The Tth DN RX HT construct was also cut with NdeI and BamHI and the smaller (approximately 450 base pairs) Tth fragment was gel isolated and purified. The Tth NdeI-BamHI insert was ligated into the Taq NdeI- BamHI vector as detailed above to generate the TaqTth(D-B) (DNA sequence SEQ ID NO:74; amino acid sequence SEQ ID NO:7).

6. Construction of TaqTth(Bs-B)

The Taq DN RX HT construct was cut with the enzymes BstBI and BamHI and the larger vector fragment was isolated as detailed above. The Tth DN RX HT construct was also cut with BstBI and BamHI and the smaller (approximately 633 base pairs) Tth fragment was gel isolated and purified. The Tth NdeI-BamHI insert was ligated into the Taq NdeI-BamHI vector as detailed above to generate TaqTth(Bs-B) (DNA sequence SEQ ID NO:75; amino acid sequence SEQ ID NO:8).

7. Construction of TaqTth(N-Bs)

The Taq DN RX HT construct was cut with the enzymes NotI and BstBI and the larger vector fragment was isolated as detailed above. The Tth DN RX HT construct was also cut with NotI and BstBI and the smaller (approximately 162 base pairs) Tth fragment was gel isolated and purified. The Tth NotI-BstBI insert was ligated into the Taq NotI-BstBI vector as detailed above to generate TaqTth(N-Bs) (DNA sequence SEQ ID NO:76; amino acid sequence SEQ ID NO:9).

8. Construction of TthTaq(B-S)

The Tth DN RX HT construct was cut with the enzymes BamHI and SalI and the larger vector fragment was isolated as detailed above. The Taq DN RX HT construct was also cut with BamHI and SalI and the smaller (approximately 741 base pairs) Tth fragment was gel isolated and purified. The Taq BamHI-SalI insert was ligated into the Tth BamHI-SalI vector as detailed above to generate the TthTaq(B-S) (DNA sequence SEQ ID NO:77; amino acid sequence SEQ ID NO:10).

9. Construction of Tth Taq(N-B)

The Tth DN RX HT construct was cut with the enzymes NotI and BamHI and the larger vector fragment was isolated as detailed above. The Taq DN RX HT construct was also cut with NotI and BamHI and the smaller (approximately 795 base pairs) Tth fragment was gel isolated and purified. The Taq NotI-BamHI insert was ligated into the Tth NotI-BamHI vector as detailed above to generate the TthTaq(N-B) (DNA sequence SEQ ID NO:78; amino acid sequence SEQ ID NO:11).

The cleavage activities of these chimerical proteins were characterized as describe in Example 1, part A, and a comparison of the cleavage cycling rates on an RNA target is shown in FIG. 12. As further discussed in the Description of the Invention, these data show that elements found in the central third of the TthPol protein are important in conferring the TthPol-like RNA-dependent cleavage activity on the chimerical proteins comprising portions of TaqPol.

Example 4

Alterations Influencing RNA-Dependent 5' Nuclease Activity do not Necessarily Influence RNA-Dependent DNA Polymerase Activity TthPol is known to have a more active RNA template dependent DNA polymerase than does the TaqPol (Myers and Gelfand, Biochemistry 30:7661 [1991]). To determine whether the RNA template dependent 5' nuclease activity of the *Thermus* DNA Pol I enzymes is related to their RNA-dependent polymerase activity, the D785N and D787N mutations used to create the polymerase-deficient versions of TaqPol and TthPol, respectively were reversed. Polymerase activity was similarly restored to the TaqTth (N) (DNA sequence SEQ ID NO:79; amino acid sequence SEQ ID NO:12), TaqTth(N-B) (DNA sequence SEQ ID NO:80; amino acid sequence SEQ ID NO:13), TaqTth(B-S) (DNA sequence SEQ ID NO:81; amino acid sequence SEQ ID NO:14) chimeras, and the TaqPol(W417L/G418K/E507Q) (DNA sequence SEQ ID NO:82; amino acid sequence SEQ ID NO:15) mutant proteins.

Polymerase function was restored in all the above mentioned enzyme mutants by inserting the BamHI to SalI fragment of the native, non-DN sequence into the selected chimera or mutant enzyme. For example, the mutant construct TaqTth(N-B) was cut with the restriction enzyme BamHI (approximate amino acid position 593) and the restriction enzyme SalI (approximate amino acid position 840). The larger vector fragment was gel purified as described in Example 3D. The native TaqPol construct was also cut with the restriction endonucleases BamHI and SalI, and the smaller insert fragment containing the native amino acid sequence was also gel purified. The insert fragment was then ligated into the vector as detailed in Experimental Example 3D.

The polymerase activities of these proteins were evaluated by extension of the $dT_{25-35}$-oligonucleotide primer with fluorescein-labeled dUTP in the presence of either poly(dA) or poly(A) template. Primer extension reactions were carried out in 10 µl buffer containing 10 mM MOPS, pH 7.5, 5 mM $MgSO_4$, 100 mM KCl. Forty ng of enzyme were used to extend 10 µM $(dT)_{25-30}$ primer in the presence of either 10 µM poly$(A)_{286}$ or 1 µM poly$(dA)_{273}$ template, 45 µM dTTP and 5 µM Fl-dUTP at 60° C. for 30 min. Reactions were stopped with 10 µl of stop solution (95% formamide, 10 mM EDTA, 0.02% methyl violet dye). Samples (3 µl) were fractionated on a 15% denaturing acrylamide gel and the fraction of incorporated Fl-dUTP was quantitated using an FMBIO-100 fluorescent gel scanner (Hitachi) equipped with a 505 nm filter as described above.

As shown in FIG. 16, the DNA-dependent polymerase activities are very similar for all constructs used in this experiment, whereas the RNA-dependent polymerase activities of TthPol, TaqTth(N) and TaqTth(B-S) are at least 6-fold higher than the activities of TaqPol, TaqTth(N-B) and the TaqPol W417L/G418K/E507Q mutant. From the analysis of these results, it can be concluded that the high RNA-dependent DNA polymerase activity of TthPol is determined by the C-terminal half of the polymerase domain (roughly, amino acids 593–830) and that the RNA-dependent 5' nuclease and polymerase activities are not related to each other, and are controlled by different regions.

Example 5

Specific Point Mutants in Taq DN RX HT Developed from Information from the Chimeric Studies The chimeric studies (Example 3, above) suggest that the part of the TthPol sequence determining its high RNA-dependent 5' nuclease activity comprises the BstBI-BamHI region located approximately between amino acid 382 and 593. Comparison of the amino acid sequences between the BstBI and BamHI regions of Tth DN RX HT and Taq DN RX HT (SEQ ID NOS:165 and 164, respectively) revealed only 25 differences (FIG. 13). Among these, 12 amino acid changes were conservative while 13 of the differences resulted in a changes in charge. Since the analysis of the chimeric enzymes suggested that the critical mutations are located in both the BstBI-NdeI and the NdeI-BamHI regions of Tth DN RX HT, site specific mutagenesis was used to introduce the Tth DN RX HT specific amino acids into the BstBI-NdeI and NdeI-BamHI regions of the TaqTth(D-B) and the TaqTth(N-D) respectively.

Six Tth DN RX HT specific substitutions were generated in the BstBI-NdeI region of the TaqTth(D-B) by single or double amino acid mutagenesis. Similarly, 12 Tth DN RX HT specific amino acid changes were introduced at the homologous position of the NdeI-BamHI region of the TaqTth(N-D).

Plasmid DNA was purified from 200 ml of JM109 overnight culture using QIAGEN Plasmid Maxi Kit (QIAGEN, Chatsworth, Calif.) according to the manufacturer's protocol to obtain enough starting material for all mutagenesis reactions. All site specific mutations were introduced using the Transformer Site Directed mutagenesis Kit (Clontech) according to the manufacturer's protocol; specific sequence information for the mutagenic primers used for each site is provided below. One of two different selection primers, Trans Oligo AlwNI/SpeI or Switch Oligo SpeI/AlwNI (Clontech, Palo Alto, Calif. catalog #6488-1 or catalog #6373-1) was used for all mutagenesis reactions described. The selection oligo used in a given reaction is dependent on the restriction site present in the vector. All mutagenic primers were synthesized by standard synthetic chemistry. Resultant colonies were *E.coli* strain JM109.

1. Construction of TaqTth(D-B) E404H (DNA Sequence SEQ ID NO:83; Amino Acid Sequence SEQ ID NO:16)

Site specific mutagenesis was performed on pTrc99A TaqTth(D-B) DNA using the mutagenic primer 240-60-01 5'-gag gag gcg ggg cac cgg gcc gcc ctt-3' (SEQ ID NO:277) to introduce the E404H mutation.

2. Construction of TaqTth(D-B) F413H/A414R (DNA Sequence SEQ ID NO:84; Amino Acid Sequence SEQ ID NO:17)

Site specific mutagenesis was performed on pTrc99A TaqTth(D-B) DNA using the mutagenic primer 240-60-02 5'-ctt tcc gag agg ctc cat cgg aac ctg tgg ggg agg-3' (SEQ ID NO:278) to introduce the F413H and the A414R mutations.

3. Construction of TaqTth(D-B) W417L/G418K (DNA Sequence SEQ ID NO:85; Amino Acid Sequence SEQ ID NO:18)

Site specific mutagenesis was performed on pTrc99A TaqTth(D-B) DNA using the mutagenic primer 240-60-03 5'-ctc ttc gcc aac ctg ctt aag agg ctt gag ggg gag-3' (SEQ ID NO:279) to introduce the W417L and the G418K mutations.

4. Construction of TaqTth(D-B) A439R (DNA Sequence SEQ ID NO:86; Amino Acid Sequence SEQ ID NO:19)

Site specific mutagenesis was performed on pTrc99A TaqTth(ND-B) DNA using the mutagenic primer 240-60-04 5'-agg ccc ctt tcc cgg gtc ctg gcc cat-3' (SEQ ID NO:280) to introduce the A439R mutation.

5. Construction of TaqTth(N-D) L451R (DNA Sequence SEQ ID NO:87; Amino Acid Sequence SEQ ID NO:20)

Site specific mutagenesis was performed on pTrc99AtaqTth(N-D) DNA using the mutagenic primer 240-60-05 5'-acg ggg gtg cgc cgg gac gtg gcc tat-3' (SEQ ID NO:281) to introduce the L415 mutation.

6. Construction of TaqTth(N-D) R457Q (DNA Sequence SEQ ID NO:88; Amino Acid Sequence SEQ ID NO:21)

Site specific mutagenesis was performed on pTrc99AtaqTth(N-D) DNA using the mutagenic primer 240-60-06 5'-gtg gcc tat ctc cag gcc ttg tcc ctg-3' (SEQ ID NO:282) to introduce the L415Q mutation.

7. Construction of TaqTth(N-D) V463L (DNA Sequence SEQ ID NO:89; Amino Acid Sequence SEQ ID NO:22)

Site specific mutagenesis was performed on pTrc99AtaqTth(N-D) DNA using the mutagenic primer 240-60-07 5'-ttg tcc ctg gag ctt gcc gag gag atc-3' (SEQ ID NO:283) to introduce the V463L mutation.

8. Construction of TaqTth(N-D) A468R (DNA Sequence SEQ ID NO:90; Amino Acid Sequence SEQ ID NO:23)

Site specific mutagenesis was performed on pTrc99AtaqTth(N-D) DNA using the mutagenic primer 240-60-08 5'-gcc gag gag atc cgc cgc ctc gag gcc-3' (SEQ ID NO:284) to introduce the A468R mutation.

9. Construction of TaqTth(N-D) A472E (DNA Sequence SEQ ID NO:91; Amino Acid Sequence SEQ ID NO:24)

Site specific mutagenesis was performed on pTrc99AtaqTth(N-D) DNA using the mutagenic primer 240-60-09 5'-gcc cgc ctc gag gag gag gtc ttc cgc-3' (SEQ ID NO:285) to introduce the A472E mutation.

10. Construction of TaqTth(N-D) G499R (DNA Sequence SEQ ID NO:92; Amino Acid Sequence SEQ ID NO:25)

Site specific mutagenesis was performed on pTrc99AtaqTth(N-D) DNA using the mutagenic primer 240-60-10 5'-ttt gac gag cta agg ctt ccc gcc atc-3' (SEQ ID NO:286) to introduce the G499R mutation.

11. Construction of TaqTth(N-D) E507Q (DNA Sequence SEQ ID NO:93; Amino Acid Sequence SEQ ID NO:26)

Site specific mutagenesis was performed on pTrc99AtaqTth(N-D) DNA using the mutagenic primer 276-046-04 5'-atc gcc aag acg caa aag acc ggc aag-3' (SEQ ID NO:287) to introduce the E507Q mutation.

12. Construction of TaqTth(N-D) Y535H (DNA Sequence SEQ ID NO:94; Amino Acid Sequence SEQ ID NO:27)

Site specific mutagenesis was performed on pTrc99AtaqTth(N-D) DNA using the mutagenic primer 240-60-11 5'-aag atc ctg cag cac cgg gag ctc acc-3' (SEQ ID NO:288) to introduce the Y535H mutation.

13. Construction of TaqTth(N-D) S543N (DNA Sequence SEQ ID NO:95; Amino Acid Sequence SEQ ID NO:28)

Site specific mutagenesis was performed on pTrc99AtaqTth(N-D) DNA using the mutagenic primer 240-60-12 5'-acc aag ctg aag aac acc tac att gac-3' (SEQ ID NO:289) to introduce the S543N mutation.

14. Construction of TaqTth(N-D) I546V (DNA Sequence SEQ ID NO:96; Amino Acid Sequence SEQ ID NO:29)

Site specific mutagenesis was performed on pTrc99AtaqTth(N-D) DNA using the mutagenic primer 240-60-13 5'-aag agc acc tac gtg gac ccc ttg ccg-3' (SEQ ID NO:290) to introduce the I546V mutation.

15. Construction of TaqTth(N-D) D551S/I553V (DNA Sequence SEQ ID NO:97; Amino Acid Sequence SEQ ID NO:30)

Site specific mutagenesis was performed on pTrc99AtaqTth(N-D) DNA using the mutagenic primer 240-60-14 5'-att gac ccc ttg ccg agc ctc gtc cac ccc agg acg ggc-3' (SEQ ID NO:291) to introduce the D551S and the I553V mutations.

16. Construction of TaqDN RX HT W417L/G418K/E507Q (DNA Sequence SEQ ID NO:98; Amino Acid Sequence SEQ ID NO:31)

The TaqDN RX HT W417L/G418K/E507Q triple mutant was made by combining the TaqTth(D-B)W417L/G418K with the TaqTth(N-D) E507Q. TaqTth(D-B)W417L/G418K was cut with the restriction enzymes NdeI and BamHI, and the larger, vector fragment was isolated as detailed in Example 3. The TaqTth(N-D) E507Q construct was also cut with NdeI and BamHI and the smaller (approximately 795 base pairs) fragment was gel isolated and purified as detailed in Example 3. The NdeI-BamHI insert was ligated into the gel purified vector, as detailed in Example 3.

17. Construction of TaqDN RX HT W417L/E507Q (DNA Sequence SEQ ID NO:99; Amino Acid Sequence SEQ ID NO:32)

Starting with TaqDN RX HT W417L/G418K/E507Q described above, mutagenic primer 337-01-02: 5'-TTC GCC AAC CTG CTT GGG AGG CTT GAG GGG GAG-3' (SEQ ID NO:292) was used in a site specific mutagenesis reaction to change the K at amino acid position 418 back to the wild-type amino acid, G. Site specific mutagenesis was done using the Transformer Site Directed Mutagenesis Kit (Clonetech) according to the manufacturer's instructions, and as described in Experimental Example 4.

18. Construction of TaqDN RX HT G418K/E507Q (DNA Sequence SEQ ID NO:100; Amino Acid Sequence SEQ ID NO:33)

Starting with TaqDN RX HT W417L/G418K/E507Q described above, mutagenic primer 337-01-01: 5'-CTC TTC GCC AAC CTG TGG AAG AGG CTT GAG GGG-3' (SEQ ID NO:293) was used in a site specific mutagenesis reaction to change the L at amino acid position 417 back to the wild-type amino acid, W. Site specific mutagenesis was done using the Transformer Site Directed Mutagenesis Kit (Clonetech) according to the manufacturer's instructions, and as described in Experimental Example 4.

Figure 14:
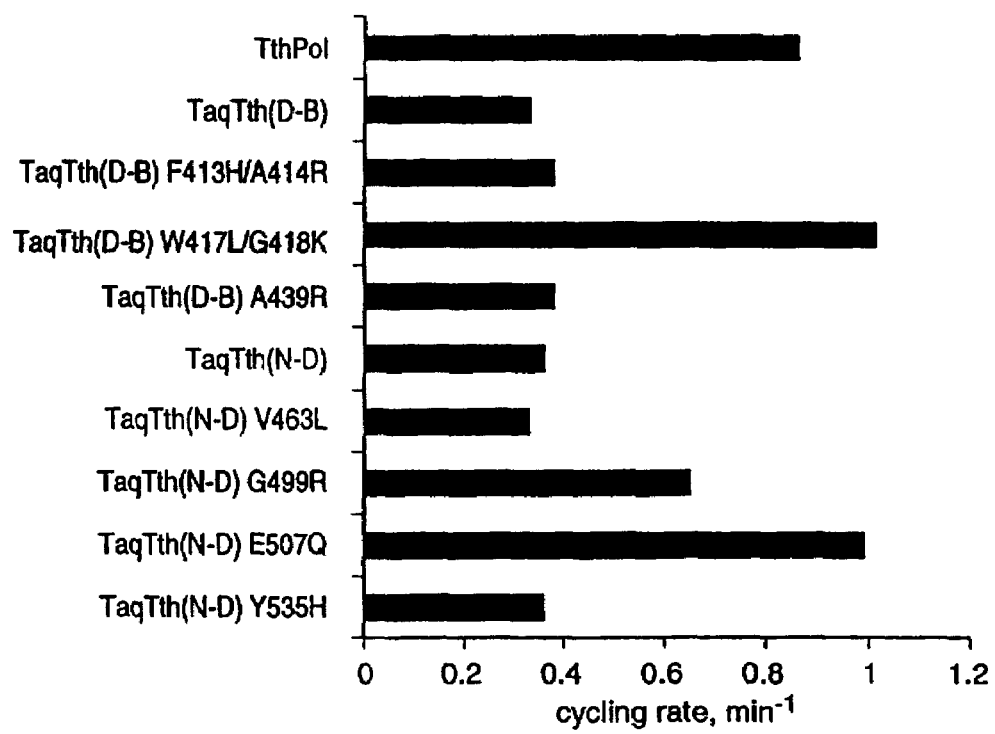
FIG. 14 compares the cycling cleavage activities of Taq DN RX HT, Taq-Tth chimerical enzymes, and chimerical enzymes having the indicated additional amino acid modifications, with IL-6 substrate having an RNA target strand.

Expression and purification of mutant proteins was done as detailed in Example 3, and the cleavage activities of these proteins were characterized as describe in Example 1, part A. A comparison of the cleavage cycling rates of a selection of these mutant proteins on an RNA target is shown in FIG. 14. As further discussed in the Description of the Invention, these data show that amino acids in the regions 417/418 and amino acid 507 are important in the conferring the TthPol-like RNA-dependent cleavage activity on the chimerical proteins comprising portions of TaqPol in combination with portions of TthPol that are not independently capable of providing enhanced RNA dependent activity (i.e., the D-B and N-D portions of Tth). As described in the Description of the Invention, Taq DN RX HT variant carrying only the W417L, G418K and E507Q substitutions were created. By comparing their cleavage rates to that of Tth DN RX HT on the IL-6 RNA substrate as described in Example 1, these mutations were determined to be sufficient to increase the Taq DN RX HT activity to the Tth DN RX HT level. FIG. 15 shows that the Taq DN RX HT W417L/G418K/E507Q and Taq DN RX HT G418K/E507Q mutants have 1.4 times higher activity than Tth DN RX HT and more than 4 fold higher activity than Taq DN RX HT, whereas the Taq DN RX HT W417L/E507Q mutant has the same activity as the enzyme, which is about 3 fold higher than Taq DN RX HT. These results demonstrate that K418 and Q507 of TthPol are particularly important amino acids in providing RNA dependent 5' nuclease activity that is enhanced compared to TaqPol.

Example 6

RNA-Dependent 5' Nuclease Properties of the Taq DN RX HT G418K/E507Q 5' Nuclease are Similar to Tth DN RX HT with Respect to Salt and Temperature Optima To determine if the G418K/E507Q mutations caused any significant changes in the properties of the Taq DN RX HT mutant in addition to the increased cleavage rate with the RNA target, the Taq DN RX HT G418K/E507Q (SEQ ID NO:33), Taq DN RX HT (SEQ ID NO276), and Tth DN RX HT (SEQ ID NO:274) enzymes were compared in the RNA template dependent 5' nuclease assay under conditions where temperature and the concentrations of salt and divalent ions were varied. The upstream DNA and the template RNA strands of the substrate used in this study were linked into a single IrT molecule (SEQ ID NO:166) as shown in FIG. 20A, and the labeled downstream probe (SEQ ID NO:167) was present in large excess. The 5' end of the target RNA strand was blocked with a biotin-streptavidin complex to prevent any non-specific degradation by the enzyme during the reaction (Lyamichev et al., Science 260:778 [1993], Johnson et al., Science 269:238 [1995]). The cleavage rates for Taq DN RX HT G418K/E507Q, Taq DN RX HT, and Tth DN RX HT are plotted as functions of temperature in FIG. 20B. The closed circles represent enzyme Taq DN RX HT, the open circles represent enzyme Tth DN RX HT, and the Xs represent enzyme Taq DN RX HT G418K/E507Q. The difference in the activities of Tth and Taq DN RX HT enzymes with the IrT substrate is even greater than the difference found with the IL-6 RNA substrate when tested in a cleavage assay as described in Example 1. The G418K/E507Q mutations increase the activity of the Taq enzyme more than tenfold and by 25% compared with the Tth enzyme. All three enzymes show a typical temperature profile of the invasive signal amplification reaction and have the same optimal temperature. No significant effect of G418K/E507Q mutations on DNA dependent 5' nuclease activity of Taq DN RX HT with the all-DNA substrate analogous to IrT (SEQ ID NO:168) under the same conditions was found.

Figure 20:
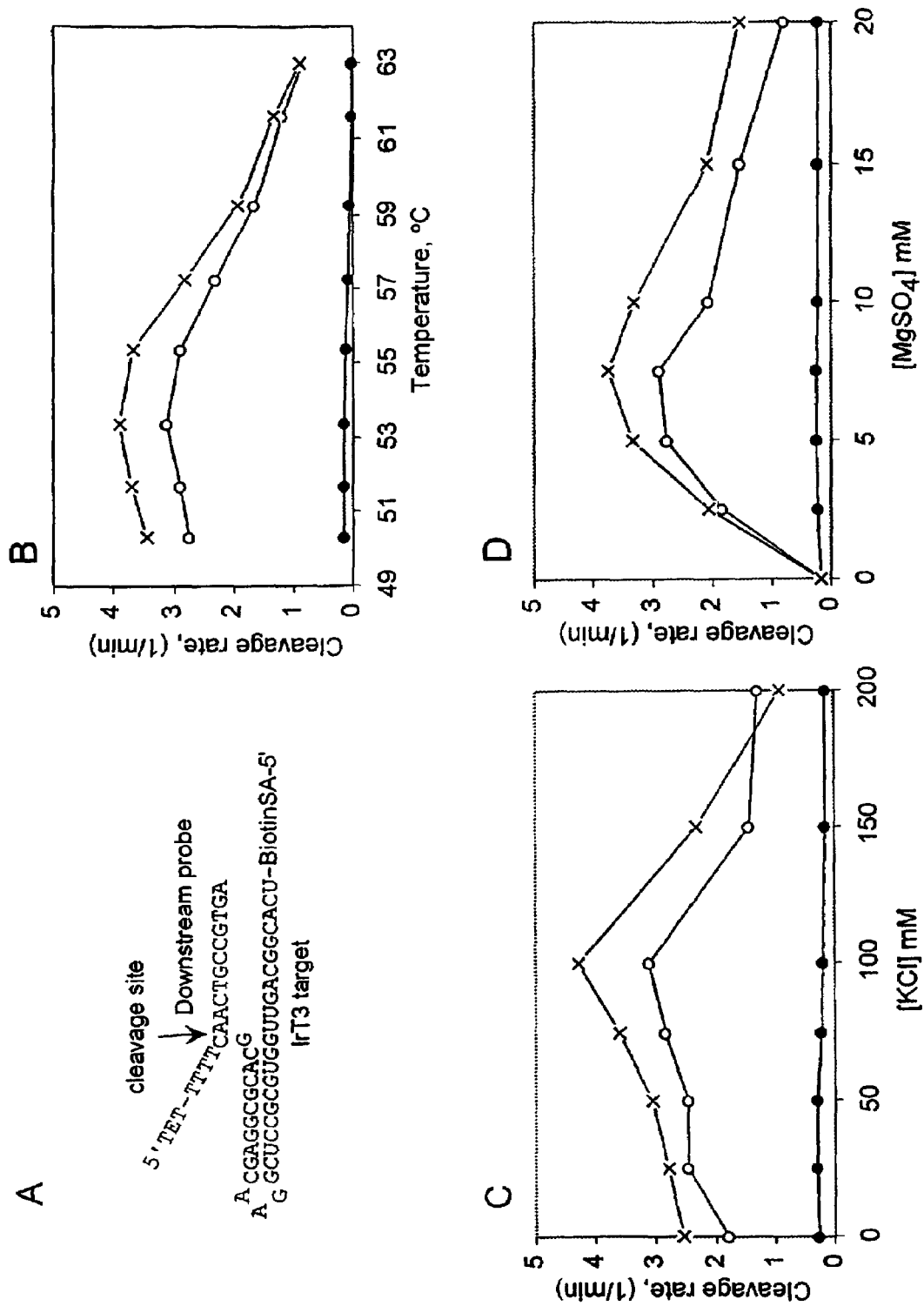
FIG. 20A shows a schematic diagram for an RNA containing invasive cleavage substrate. The 5' end of the target molecule (SEQ ID NO:166) is modified with biotin and blocked with streptavidin as described. The downstream probe (SEQ ID NO:167) with cleavage site is also shown. Panels B-D show analysis of the properties of the Taq DN RX HT G418K/E507Q mutant in cleavage of the shown substrate under conditions of varying reaction temperature, KCl concentration, and MgSO$_4$ concentration.

The effects of KCl and $MgSO_4$ concentrations on the 5' nuclease activity of Taq DN RX HT G418K/E507Q, Taq DN RX HT, and Tth DN RX HT with the IrT substrate are shown in FIGS. 20C and D. The activities of all enzymes have similar salt dependencies with an optimal KCl concentration of 100 mM for Taq DN RX HT G418K/E507Q and Tth DN RX HT and 50 mM for Taq DN RX HT. The optimal $MgSO_4$ concentration for all enzymes is approximately 8 mM. The analysis of the data presented in FIG. 20 suggests that the properties of Taq DN RX HT G418K/E507Q are much closer to those of Tth DN RX HT rather than Taq DN RX HT confirming the key role of the G418K/E507Q mutations in the recognition of the substrate with an RNA target.

To understand the mechanism of the reduction of the 5' nuclease activity in the presence of an RNA versus a DNA target, the Michaelis constant ($K_m$) and the maximal catalytic rate ($k_{cat}$) of all three enzymes were determined, using an excess of the IrT substrate (SEQ ID NO:166) and the downstream probe (SEQ ID NO:167) and a limiting enzyme concentration. For these measurements, ten-µl reactions were assembled containing 10 mM MOPS, pH 7.5, 0.05% Tween 20, 0.05% Nonidet P-40, 10 µg/ml tRNA, 4 mM $MgCl_2$, 1 nM of enzyme (Taq DN RX HT, Tth DN RX HT, or Taq DN RX HT G418K/E507Q) and different concentrations (0.125, 0.25, 0.5 or 1 µM) of an equimolar mixture of the IrT target and the downstream probe. The cleavage kinetics for each enzyme and each substrate concentration were measured at 46° C. Reactions were stopped by the addition of 10 µl of 95% formamide containing 10 mM EDTA and 0.02% methyl violet (Sigma). One µl of each stopped reaction digest was fractionated on a 20% denaturing acrylamide gel (19:1 cross-linked), with 7M urea, and in a buffer of 45 mM Tris-borate, pH 8.3, 1.4 mM EDTA. Gels were scanned on an FMBIO-100 fluorescent gel scanner (Hitachi) using a 585 nm filter. The fraction of cleaved product (determined from intensities of bands corresponding to uncut and cut substrate with FMBIO Analysis software, version 6.0, Hitachi) was plotted as a function of reaction time. The initial cleavage rates were determined from the slopes of linear part of the cleavage kinetics and were defined as the concentration of cut product divided by the enzyme concentration and the time of the reaction (in minutes). The Michaelis constant $K_m$ and the maximal catalytic rate $k_{cat}$ of each enzyme with IrT substrate were determined from the plots of the initial cleavage rate as functions of the substrate concentration.

It was found that all three enzymes have similar $K_m$ values (in the range of 200–300 nM) and $k_{cat}$ values of approximately 4 $min^{-1}$ for Taq DN RX HT and Tth DN RX HT and of 9 $min^{-1}$ for Taq DN RX HT G418K/E507Q. That the G418K/E507Q mutations increase the $k_{cat}$ of Taq DN RX HT more than two fold, but have little effect on $K_m$ suggest that the mutations position the substrate in an orientation more appropriate for cleavage, rather than simply increase the binding constant.

Example 7

Use of Molecular Modeling to Further Improve RNA-Dependent 5' Nuclease Activity

A. Point Mutants

To develop enzymes with altered function, sequence changes were introduced by site-specific mutagenesis in predetermined locations or by random mutagenesis. Locations for site-specific mutagenesis were chosen based on evidence from chimeric studies, relevant published literature, and molecular modeling. Seven additional mutant enzymes were developed from the Tth DN RX HT enzyme, and twenty additional mutant enzymes were developed from the Taq DN RX HT enzyme, both discussed previously. Some of the mutant enzymes are the result of multiple mutagenesis reactions, that is, more than one change has been introduced to obtain the final product. Mutation reactions were done using the Tth DN RX HT construct (SEQ ID NO:273) described in Example 2C2, or the Taq DN RX HT construct (SEQ ID NO:275), described in Example 2C1 unless otherwise stated. Plasmid DNA was purified from 200 ml of JM109 overnight culture using QIAGEN Plasmid Maxi Kit (QIAGEN, Chatsworth, Calif.) according to the manufacturer's protocol to obtain enough starting material for all mutagenesis reactions. All site-specific mutations were introduced using the Transformer Site Directed mutagenesis Kit (Clontech) according to the manufacturer's protocol. One of two different selection primers, Trans Oligo AlwNI/SpeI or Switch Oligo SpeI/AlwNI (Clontech, Palo Alto Calif. catalog #6488-1 or catalog #6373-1) was used for all mutagenesis reactions described. The selection oligo used in a given reaction is dependent on the restriction site present in the vector. All mutagenic primers for both the site-specific mutagenesis and the random mutagenesis were synthesized by standard synthetic chemistry. Resultant colonies for both types of reactions were E. coli strain JM109. Random mutagenesis methods are described below.

Mutants were tested via the rapid screening protocol detailed in Example 1. Then, if more detailed analysis was desired, or if a larger protein preparation was required, expression and purification of mutant proteins was done as detailed in Example 3.

1. Construction of Tth DN RX HT H641A, Tth DN RX HT H748A, Tth DN RX HT H786A

Site specific mutagenesis was performed on pTrc99A Tth DN RX HT DNA using the mutagenic primer 583-001-02: 5'-gct tgc ggt ctg ggt ggc gat gtc ctt ccc ctc-3' (SEQ ID NO:294) to introduce the H641A mutation (DNA sequence SEQ ID NO:101; amino acid sequence SEQ ID NO:34), or the mutagenic primer 583-001-03: 5' cat gtt gaa ggc cat ggc ctc cgc ggc ctc cct-3' (SEQ ID NO:295) to generate the H748A mutant (DNA sequence SEQ ID NO:102; amino acid sequence SEQ ID NO:35), or the mutagenic primer 583-001-04: 5'-cag gag gag ctc gtt ggc gac ctg gag gag-3' (SEQ ID NO:296) to generate the H786A mutant enzyme (DNA sequence SEQ ID NO:103; amino acid sequence SEQ ID NO:36).

2. Construction of Tth DN RX HT (H786A/G506K/Q509K)

Starting with the mutant Tth DN RX HT H786A, generated above, site specific mutagenesis was done using the mutagenic primer 604-022-02: 5'-gga gcg ctt gcc tgt ctt ctt cgt ctt ctt caa ggc ggg agg cct-3' (SEQ ID NO:297) to generate this variant termed "TthAKK", (DNA sequence SEQ ID NO:104; amino acid sequence SEQ ID NO:37).

3. Construction of Taq DN RX HT (W417L/G418K/E507Q/H784A)

Mutagenic oligonucleotide 158-029-02: 5'-gag gac cag ctc gtt ggc gac ctg aag gag cat-3' (SEQ ID NO:298) was used in a site specific mutagenesis reaction to introduce the H784A mutation and generate this construct termed "Taq4M" (DNA sequence SEQ ID NO:105; amino acid sequence SEQ ID NO:38).

4. Construction of Taq4M H639A, Taq4M R587A, Taq4M G504K and Taq4M G80E

Site specific mutagenesis was done on the Taq4M mutant, using primer 473-010-11: 5'-gagggcgggacatcgccacggagac-cgccagc-3' (SEQ ID NO:299) to generate the Taq 4M H639A mutant (DNA sequence SEQ ID NO:106; amino acid sequence SEQ ID NO:39), primer 473-010-10: 5'-cag aac atc ccc gtc gcc acc ccg ctt ggg cag-3' (SEQ ID NO:300) to generate Taq 4M R587A (DNA sequence SEQ ID NO:107; amino acid sequence SEQ ID NO:40), primer 300-081-06: 5'-ggg ctt ccc gcc atc aag aag acg gag aag acc-3' (SEQ ID NO:301) to generate Taq 4M G504K (DNA sequence SEQ ID NO:108; amino acid sequence SEQ ID NO:41), and primer 330-088-04: 5'-cta ggg ctt ccc gcc atc aag aag acg caa aag acc ggc-3' (SEQ ID NO:302) to generate the Taq 4M G80E mutant (DNA sequence SEQ ID NO:109; amino acid sequence SEQ ID NO:42).

5. Construction of Taq 4M P88E/P90E and Taq 4M L109F/A110T

Starting with Taq 4M described above, site specific mutagenesis was done using primer 473-087-03: 5'-ccg ggg aaa gtc ctc ctc cgt ctc ggc ccg gcc cgc ctt-3' (SEQ ID NO:303) to generate the P88E/P90E mutations (DNA sequence SEQ ID NO:110; amino acid sequence SEQ ID NO:43), or primer 473-087-05: 5'-cgg gac ctc gag gcg cgt gaa ccc cag gag gtc cac-3' (SEQ ID NO:304) to generate the L109F/A110T mutations (DNA sequence SEQ ID NO:111; amino acid sequence SEQ ID NO:44).

6. Construction of Taq DN RX HT (W417L/G418K/G499R/A502K/I503L/G504K/E507K/H784A)

Two PCR reactions were performed, first using construct Taq4M (Taq W417L/G418K/G504K/E507Q/H784A) as a template. Using primers 158-84-01 5'-CTCCTCCAC-GAGTTCGGC-3' (SEQ ID NO:305) and 535-33-02 5'-ACC GGT CTT CTT CGT CTT CTT CAA CTT GGG AAG CCT GAG CTC GTC AAA-3' (SEQ ID NO:306) a 620 base pair PCR fragment was generated. Another 510 base pair PCR product was generated using primer 535-33-01 5'-AAG ACG AAG AAG ACC GGT AAG CGC TCC ACC AGC-3' (SEQ ID NO:307) and 330-06-03 5'-GTC GAC TCT AGA TCA GTG GTG GTG GTG GTG GTG GTG CTT GGC CGC CCG GCG CAT C-3' (SEQ ID NO:308). The two PCR products overlap such that a final recombinant PCR amplification was done using the outside primers 158-84-01 and 330-06-03 to yield the 1182 base pair product. The recombinant PCR product was digested with the restriction enzymes NotI and BamHI according to the manufacturer's instructions to yield a 793 base pair fragment. The parent plasmid Taq4M was also digested with the same enzymes and used as the vector for ligation. All DNA fragments were TAE agarose gel purified prior to ligation. The fragment was ligated into the vector, and transformed into JM109 cells, thus incorporating the mutations G499R, A502K, I503L, and E507K as well as the restriction endonuclease site, AgeI. This construct is termed "Taq 8M" (DNA sequence SEQ ID NO:112; amino acid sequence SEQ ID NO:45).

B. Random Mutagenesis

Numerous enzymes with altered function were generated via random mutagenesis. The regions of the protein targeted for random mutagenesis were chosen based on molecular modeling data and from information in the literature. Different mutagenic primers were used to introduce mutations into different regions of the protein. Random mutagenesis was performed on the Taq variant Taq 4M G504K (Taq DN RX HT W417L/G418K/G504K/E507Q/H784A/) (SEQ ID NO:108) described above and mutant PCR fragments generated in the mutagenesis reaction were exchanged for homologous regions in Taq8M (SEQ ID NO:112) unless otherwise stated.

Random mutagenesis was also performed on the Tth DN RX HT H786A (SEQ ID NO:103) described above. Mutant PCR fragments generated with the Tth DN RX HT H786A template were exchanged for homologous regions in the unaltered Tth DN RX HT H786A.

1. Random Mutants in Amino Acid Residues 500–507 or 513–520

The first mutagenic oligonucleotide, 535-054-01: 5'-gga gcg ctt acc ggt ctt (ttg cgt ctt ctt gat ctt ggg aag) cct tag ctc gtc aaa gag-3' (SEQ ID NO:309) was used in conjunction with 158-84-01: 5'-CTC CTC CAC GAG TTC GGC-3' (SEQ ID NO:310) to install random residues from amino acid position 500 to 507 of Taq polymerase variant Taq DN RX HT W417L/G418K/G504K/E507Q/H784A (SEQ ID NO:108). This was accomplished by synthesizing the primer 535-054-01 such that only 91% of the bases within the parenthesis are unaltered while the remaining 9% of the bases are an equal mixture of the other 3 nucleotides. The initial, unaltered sequence of this oligo includes the G499R, A502K and the Q507K changes.

To generate mutations in the region 500–507, primer 535-054-01 and primer 158-84-01 were used in a PCR reaction, using the Advantage cDNA PCR kit (Clonetech) and Taq variant described above, as the target. This PCR fragments was then run on a 1% TAE agarose gel, excised and purified with QIAquick Gel Extraction Kit (Qiagen, Valencia Calif., catalog # 28706). The purified fragment was cut with NotI and AgeI and ligated into pTaq8M that had been linearized with NotI and AgeI. JM109 E.coli cells (Promega) were transformed with the ligated products. Clones were tested as described below.

The second mutagenic oligonucleotide (used in a separate reaction) 535-054-02: 5'-caa aag acc ggt aag cgc (tcc acc agc gcc gcc gtc ctg gag) gcc ctc cgc gag gcc cac-3' (SEQ ID NO:311) was used in conjunction with 330-06-03: 5'-GTC GAC TCT AGA TCA GTG GTG GTG GTG GTG GTG CTT GGC CGC CCG GCG CAT C-3' (SEQ ID NO:312) to install random residues from amino acid 513–520. The bases within the parenthesis of primer 535-054-02 are also 91% wild-type and 3% each of the other 3 nucleotides.

To generate mutations in the region 513–520, primer 535-054-02 and primer 535-054-02 were used in a PCR reaction with Taq DN RX HT W417L/G418K/G504K/E507Q/H784A (SEQ ID NO:108) as template, as described above. The resulting PCR fragment was purified as above and cut with the restriction enzymes AgeI and BamHI. The cut fragment was then ligated into the Taq8M construct, also linearized with AgeI and BamHI. JM109 E.coli cells were transformed with the ligated products. Clones were tested as described Example 1. Mutants developed from these include:

Taq DN RX HT W417L/G418K/G499R/A502K/K504N/E507K/H784A (M1–13) (DNA sequence SEQ ID NO:113; amino acid sequence SEQ ID NO:46).

Taq DN RX HT W417L/G418K/G499R/L500I/A502K/G504K/Q507H/H784A (M1–36) (DNA sequence SEQ ID NO:114; amino acid sequence SEQ ID NO:47).

Taq DN RX HT W417L/G418K/G499R/A502K/I503L/G504K/E507K/T514S/H784A (M2–24) (DNA sequence SEQ ID NO:115; amino acid sequence SEQ ID NO:48).

Taq DN RX HT W417L/G418K/G499R/A502K/I503L/G504K/E507K/V518L/H784A (M2–06) (DNA sequence SEQ ID NO:116; amino acid sequence SEQ ID NO:49).

2. TthDN RX HT H786A Random Mutagenesis

To generate mutants in the helix-hairpin-helix region of the TthDN RX HT H786A (SEQ ID NO:36) enzyme, two different PCR reactions were performed using the H786A (SEQ ID NO:103) mutant as a template. The two PCR products overlap such that a recombinant PCR reaction can be performed (Higuchi, in PCR Technology, H. A. Erlich, ed., Stockton Press, New York. pp61–70 [1989]). This final PCR product is then exchanged with the homologous region of the TthDN H786A mutant by using restriction enzyme sites located on the ends of the fragment and within the TthDN H786A sequence.

Starting with TthDN H786A discussed above, and using primer 604-08-06: 5'-gtc gga ggg gtc ccc cac gag-3' (SEQ ID NO:313) and primer 390-76-08: 5'-tgt gga att gtg agc gg (SEQ ID NO:314), a 620 base pair PCR fragment was generated. PCR reactions were performed using the Advantage cDNA PCR kit (Clontech) according to manufacturer's instructions. This PCR product includes amino acids 1–194. No mutations were introduced via this reaction, however the restriction enzyme site EcoRI is present at the 5' end.

Starting with TthDN RX HT H786A discussed above, and using mutagenic primer 604-08-05: 5'-ctc gtg ggg gac ccc tcc gac aac ctc (ccc ggg gtc aag ggc atc ggg gag aag acc gcc) ctc aag ctt ctc aag-3' (SEQ ID NO:315) and primer 209-74-02: 5'-gtg gcc tcc ata tgg gcc agg ac-3' (SEQ ID NO:316) a 787 base pair PCR fragment was generated. PCR reactions were done as above. This fragment does contain random mutations, due to the presence of the mutagenic primer, 604-08-05. The bases within the parenthesis of this primer were synthesized such that 91% of the sequence is wild-type, while the additional 9% is evenly divided between the remaining 3 bases.

The two PCR fragments overlap, and were combined in a recombinant PCR reaction. Primers 390-76-08 and 209-74-02 were added, and the Advantage cDNA PCR kit (Clontech) was again used according to manufacturer's instructions. A 1380 base pair product was generated from this reaction.

The recombinant PCR product was cut with the restriction enzymes EcoRI and NotI according to the manufacturer's instructions to yield a 986 base pair fragment. TthDN RX HT H786A was prepared by cutting with the same enzymes. The fragment was then ligated into the vector, and transformed into JM109 cells. New mutants developed from this set of reactions include:

TthDN RX HT H786A/P197R/K200R (DNA sequence SEQ ID NO:117; amino acid sequence SEQ ID NO:50).

TthDN RX HT H786A/K205Y (DNA sequence SEQ ID NO:118; amino acid sequence SEQ ID NO:51).

TthDN RX HT H786A/G203R (DNA sequence SEQ ID NO:119; amino acid sequence SEQ ID NO:52).

3. Construction of Taq DN RX HT W417L/G418K/H784A L109F/A110T/G499R/A502K/I503L/G504K/E507K/T514S (Taq SS)

Starting with Taq DN RX HT W417L/G418K/G499R/A502K/I503L/G504K/E507K/T514S/H784A (SEQ ID NO:115) mutant described above, primer 473-087-05: 5'-cgg gac ctc gag gcg cgt gaa ccc cag gag gtc cac-3' (SEQ ID NO:317) was used in conjunction with the appropriate selection primer in a site specific mutagenesis reaction to incorporate the L109F and A110T mutations to generate this enzyme, termed "TaqSS" (DNA sequence SEQ ID NO:120; amino acid sequence SEQ ID NO:53).

4. Construction of Taq DN RX HT W417L/G418L/H784A P88E/P90E/G499R/A502K/I503L/G504K/E507K/T514S Starting with Taq DN RX HT W417L/G418K/G499R/A502K/I503L/G504K/E507K/T514S/H784A (SEQ ID NO:115) mutant described above, primer 473-087-03: 5'-ccg ggg aaa gtc ctc ctc cgt ctc ggc ccg gcc cgc ctt-3' (SEQ ID NO:318) was used in conjunction with the appropriate selection primer in a site specific mutagenesis reaction to incorporate the P88E and P90E mutations to generate this enzyme (DNA sequence SEQ ID NO:121; amino acid sequence SEQ ID NO:54).

5. TaqSS Random Mutagenesis

Random mutagenesis was used to introduce additional changes in the helix-hairpin-helix domain of the TaqSS mutant (SEQ ID NO:120). The mutagenesis was done as described in example 9 above. In the first step, two different but overlapping PCR products were generated. One of the PCR products, generated with oligos 390-76-08 (SEQ ID NO:314), and 604-08-04: 5'-gtc gga ctc gtc acc ggt cag ggc-3' (SEQ ID NO:319) incorporates the EcoRI site into the fragment, but does not incorporate any mutations. The second PCR product utilizes mutagenic primer 604-08-03: 5'-ctg acc ggt gac gag tcc gac aac ctt (ccc ggg gtc aag ggc atc ggg gag aag acg gcg) agg aag ctt ctg gag-3' (SEQ ID NO:320) and primer 209-74-02 (SEQ ID NO:316). This fragment contains random point mutations, and when combined via recombinant PCR with the first fragment, can be cut with the restriction enzymes EcoRI and NotI, and ligated into the TaqSS construct, also cut with EcoRI and NotI. The ligated construct was then transformed into JM109. Colonies were screened as described below. Enzymes developed from this mutagenesis include:

TaqSS K198N (DNA sequence SEQ ID NO:112; amino acid sequence SEQ ID NO:55).

TaqSS A205Q (DNA sequence SEQ ID NO:123; amino acid sequence SEQ ID NO:56).

TaqSS I200M/A205G (DNA sequence SEQ ID NO:124; amino acid sequence SEQ ID NO:57).

TaqSS K203N (DNA sequence SEQ ID NO:125; amino acid sequence SEQ ID NO:58).

TaqSS T204P (DNA sequence SEQ ID NO:126; amino acid sequence SEQ ID NO:59).

6. Construction of TaqSS R677A

To generate enzymes with sequence changes in both the arch region and in the polymerase region, additional specific point mutations were generated in TaqSS. Site specific mutagenesis was performed as described above using the oligo 473-060-10: 5'-tag ctc ctg gga gag ggc gtg ggc cga cat gcc-3' (SEQ ID NO:321) to generate the TaqSS R677A mutant (DNA sequence SEQ ID NO:127; amino acid sequence SEQ ID NO:60).

7. Construction of TaqTthAKK (DNA Sequence SEQ ID NO:128; Amino Acid Sequence SEQ ID NO:61) and TthTaq5M (DNA Sequence SEQ ID NO:129; Amino Acid Sequence SEQ ID NO:62)

Chimeric mutant TaqTthAKK and TthTaq5M were generated by cutting Tth DN RX HT (H786A/G506K/Q509K) (SEQ ID NO:104; here abbreviated TthAKK) or Taq 4M G504 (SEQ ID NO:108; here abbreviated Taq 5M) with the restriction endonucleases EcoRI and NotI. The smaller insert fragments as well as the larger vector fragments were gel purified as detailed in Example 3D, and the insert fragments were exchanged between the two mutants and ligated as described in Example 3D. Screening and verification of the construct sequence was also done as in Example 3D.

Example 8

Improvement of RNA-Dependent 5' Nuclease Activity in other Polymerases

Information gained from the TaqPol/TthPol recombinations, mutagenesis and modeling, was used to make comparable mutations in additional DNA polymerases and examined the effects on the cleavage activities of these enzymes. The DNA polymerases of *Thermus filiformis* (TfiPol) and *Thermus scotoductus* (TscPol) were cloned and purified as described in Example 2. The mutagenesis of these two proteins is described below.

A. Construction of TfiPolDN2M

Mutagenesis of pTrc99a-TfiPol (SEQ ID NO:249) was done using the QuikChange site-directed mutagenesis kit (Stratagene) according to the manufacturer's protocol. The P420K mutation was made with the following two oligonucleotides; 5'-CTTCCAGAACCTCTTTAAACG-GCTTTCCGAGAAG (SEQ ID NO:322) and 5'-CT-TCTCGGAAAGCCGTTTAAAGAGGTTCTGGAAG (SEQ ID NO:323). The E507Q mutation was made with the following two oligonucleotides; 5'-CCGGTGGGCCG-GACGCAGAAGACGGGCAAGC (SEQ ID NO:324) and 5'-GCTTGCCCGTCTTCTGCGTCCGGCCCACCGG (SEQ ID NO:325). The D785N mutation was made with the following two oligonucleotides; 5'-CTCCTCCAAGTGCA-CAACGAGCTGGTCCTGG (SEQ ID NO:326) and 5'-CCAGGACCAGCTCGTTGTGCACTTGGAGGAG (SEQ ID NO:327). The plasmid containing all three mutations is called pTrc99a-TfiPolDN2M, (DNA sequence SEQ ID NO:130; amino acid sequence SEQ ID NO:63).

B. Construction of TscPolDN2M

Mutagenesis of pTrc99a-TscPol (SEQ ID NO:253) was done with the QuikChange site-directed mutagenesis kit (Stratagene) according to the manufacturer's protocol. The E416K mutation was made with the following two oligonucleotides; 5'-GCCGCCCTCCTGAAGCGGCTTAAGGG (SEQ ID NO:328) and 5'-CCCTTAAGCCGCTTCAG-GAGGGCGGC (SEQ ID NO:329). The E505Q mutation was made with the following two oligonucleotides; 5'-ATCGGCAAGACGCAGAAGACGGGCAAGC (SEQ ID NO:330) and 5'-GCTTGCCCGTCTTCTGCGTCTTGC-CGAT (SEQ ID NO:331). The D783N mutation was made with the following two oligonucleotides; 5'-TTGCAGGTG-CACAACGAACTGGTCCTC (SEQ ID NO:332) and 5'-GAGGACCAGTTCGTTGTGCACCTGCAA (SEQ ID NO:333). The plasmid containing all three mutations is called pTrc99a-TscPolDN2M, (DNA sequence SEQ ID NO:131; amino acid sequence SEQ ID NO:64).

C. Chimerics of Tsc, Tfi, Tth and Taq Mutants

1. Construction of TfiTth AKK (DNA Sequence SEQ ID NO:132; Amino Acid Sequence SEQ ID NO:65), TscT-thAKK (DNA Sequence SEQ ID NO:133; Amino Acid Sequence SEQ ID NO:66), TfiTaq5M (DNA Sequence SEQ ID NO:134; Amino Acid Sequence SEQ ID NO:67) and TscTaq5M (DNA Sequence SEQ ID NO:135; Amino Acid Sequence SEQ ID NO:68)

To generate chimeric enzymes between Tth DN RX HT (H86A/G506K/Q509K) (here abbreviated TthAKK, SEQ ID NO:104) or Taq 4M G504 (here abbreviated Taq 5M, SEQ ID NO:108), and Tfi DN 2M (SEQ ID NO:130), or Tsc DN 2M (SEQ ID NO:131), additional restriction endonuclease sites were introduced by site specific mutagenesis into the named Tfi and Tsc mutants. Mutagenic primers 700-011-01 5'-cag acc atg aat tcc acc cca ctt ttt gac ctg gag-3' (SEQ ID NO:334) and 700-011-02 5'-gtg gac gcg gcc gcc cga ggc cgc cgc cag ggc cag-3' (SEQ ID NO:335) were used to introduce an EcoRI site at amino acid position 1 and a NotI site at amino acid position 331 in Tfi DN 2M. Mutagenic primers 700-011-03 5'-cag acc atg aat tcc ctg ccc ctc ttt gag ccc aag-3' (SEQ ID NO:336) and 700-011-04 5'-gta aac cgc gcc gcc cca ggc ggc ggc caa ggc gtt-3' (SEQ ID NO:337) were used to introduce an EcoRI site at amino acid position 1 and a NotI site at amino acid position 327 in Tsc DN 2M. PCR reactions were done using the Advance cDNA PCR kit (Clonetech) according to manufacturer's instructions and either Tfi DN 2M or Tsc DN 2M as target, with their corresponding primers. The 1017 base pair PCR products were cut with both EcoRI and NotI to yield 993 base pair insert fragments that were gel purified as described in Example 3D. The mutants Taq4M G504K (SEQ ID NO:108) and Tth DN RX HT (H786A/G506K/Q509K) (SEQ ID NO:104) were also cut with EcoRI and NotI, and the larger, vector fragment was gel isolated as above. Ligations were performed as detailed in Example 3D, as was the screening and verification of the new constructs.

Example 9

Additional Enzymes having Improved RNA-Dependent 5' Nuclease Activity

Generation of Tfi DN 2M(ΔN)

To facilitate later cloning steps, an endogenous restriction enzyme site (Not I) was removed from the polymerase region of the TfiPolDN2M gene (SEQ ID NO:130 described in Example 8A), and a unique Not I site was inserted in a more advantageous position.

The endogeneous Not I site was removed as follows. The QUIKCHANGE Site-Directed Mutagenesis Kit from (Stratagene) was used according to manufacturer's instructions with the mutagenic primers 5'-gag-gtg-gag-cgg-ccc-ctc-tcc-cgg-gtc-ttg (SEQ ID NO: 338) and 5'-caa-gac-ccg-gga-gag-ggg-ccg-ctc-cac-ctc (SEQ ID NO: 339). The new construct was named Tfi DN 2M(ΔN) (DNA sequence SEQ ID NO: 340; amino acid sequence SEQ ID NO: 341).

Generation of Tfi DN 2M(N), Tse DN 2M(N)

To install a unique NotI site (at amino acid position 328) in Tfi DN 2M(ΔN) (SEQ ID NO: 340), primers 886-088-07 (SEQ ID NO: 342) 5'-tgg-cgg-cgg-cct-cgg-gcg-gcc-gcg-tcc-acc-ggg-caa-ac-3' and 700-010-03 5'-ctt-ctc-tca-tcc-gcc-aaa-aca-gcc (SEQ ID NO: 343) were used in a PCR reaction with Tfi DN 2M(ΔN) (SEQ ID NO: 340) as template. The resulting PCR fragment was purified and cut with the restriction enzymes NotI and SalI. The cut fragment was then ligated into the TfiTthAKK (SEQ ID NO:132, described in example 8,C) construct which was also digested with NotI and SalI. The new construct was termed Tfi DN 2M(N) (DNA sequence SEQ ID NO: 345; amino acid sequence SEQ ID NO: 346).

To introduce a Not I restriction endonuclease site into mutant TscPol DN 2M (previously described in Example 8B above), PCR was performed with primers: 886-088-05 (SEQ ID NO: 344) 5'-tgg-ccg-ccg-cct-ggg-gcg-gcc-gcg-ttt-acc-ggg-cgg-ag-3' and 700-010-03 (SEQ ID NO: 343) 5'-ctt-ctc-tca-tcc-gcc-aaa-aca-gcc-3' using TscPolDN2M (SEQ ID NO:131) as template. The NotI-SalI digested fragment of the PCR product was then sub-cloned into NotI and SalI digested TscTthAKK vector (SEQ ID NO:133). The resulting construct was termed Tsc DN 2M(N) (DNA sequence SEQ ID NO:347; amino acid sequence SEQ ID NO:348).

Generation of Tfi DN 2M(N)AKK and Tsc DN2M(N)AKK

To generate the "AKK" set of mutations (G504K/E507K/H784A/D785N), site specific mutagenesis was done on the Tfi DN 2M(N) mutant (DNA sequence SEQ ID NO: 345), using primers 959-022-01 to -04: 5'-ggc-ctc-acc-ccg-gtg-aag-cgg-acg-aag-aag-acg-ggc-aag-cgc-3', 5'-gcg-ctt-gcc-cgt-ctt-ctt-cgt-ccg-ctt-cac-cgg-ggt-gag-gcc-3', 5'-ctc-ctc-ctc-caa-gtg-gcc-aac-gag-ctg-gtc-ctg-3', 5'-cag-gac-cag-ctc-gtt-ggc-cac-ttg-gag-gag-gag-3' (SEQ ID NO: 354–357) to generate the Tfi 2M(N)AKK mutant (DNA sequence SEQ ID NO: 358; amino acid sequence SEQ ID NO: 359). This construct is termed "TfiAKK".

To install the "AKK" set of mutations (G502K/E505K/H782A/D783N), into the TscDN 2M (N) construct, (DNA sequence SEQ ID NO: 347) primers 959-022-05 to -08: 5'-ggg-ctt-ccc-gcc-atc-aag-aag-acg-aag-aag-acg-ggc-aag-cgc-3', 5'-gcg-ctt-gcc-cgt-ctt-ctt-cgt-ctt-ctt-gat-ggc-ggg-aag-ccc-3', 5'-atg-ctt-ttg-cag-gtg-gcc-aac-gaa-ctg-gtc-ctc-3', 5'-gag-gac-cag-ttc-gtt-ggc-cac-ctg-caa-aag-cat-3' (SEQ ID NO: 360–363) were used to generate Tsc2M(N)AKK (DNA sequence SEQ ID NO: 364; amino acid sequence SEQ ID NO: 365). This construct is termed "Tsc AKK".

Construction of Point Mutants by Recombinant PCR

Construction of TthAKK(P195A) and TthAKK(P195K)

To introduce mutations at amino acid position 195 (either a P195A or P195K) in the nuclease domain of TthAKK construct, mutagenic primer 785-073-01 (P195A) 5'-ccc-tcc-gac-aac-ctc-gcc-ggg-gtc-aag-ggc-atc-3' (SEQ ID NO: 370) or 785-073-02 (P195K) 5'-ccc-tcc-gac-aac-ctc-aag-ggg-gtc-aag-ggc-atc-3' (SEQ ID NO: 371) and primer 209-074-02: 5'-gtg-gcc-tcc-ata-tgg-gcc-agg-ac-3' (SEQ ID NO:316) were used in a PCR reaction to generate a 787 base pair fragment. Another PCR fragment was obtained by using the primers: 390-076-08 5'-tgt-gga-att-gtg-agc-gg-3' (SEQ ID NO:314) and 785-073-03 5'-gag-gtt-gtc-gga-ggg-gtc-3' (SEQ ID NO: 372) in a reaction with the same template.

The two PCR fragments overlap and were combined in a recombinant PCR reaction. The outside primers 390-076-08 and 209-074-02 were added, and the Advantage cDNA PCR kit (Clontech) was used according to manufacturer's instructions. A 1380 base pair product was generated from this reaction.

The recombinant PCR product was cut with the restriction enzymes EcoRI and NotI to yield a 986 base pair fragment. The TthAKK construct was prepared by cutting with the same enzymes. The fragment was then ligated into the vector, and transformed into JM109 cells. New mutants developed from this set of reactions include: Tt AKK (P195A) (DNA sequence SEQ ID NO: 373; amino acid sequence SEQ ID NO: 374) and TthAKK(P195K) (DNA sequence SEQ ID NO: 375; amino acid sequence SEQ ID NO: 376).

Construction of TthAKK(N417K/L418K)

The same approach was used to construct TthAKK (N417K/L418K). Two overlapping PCR fragments were generated by mutagenic primers: 785-73-07 5'-gag-agg-ctc-cat-cgg-aag-aag-ctt-aag-cgc-ctc-gag-3' (SEQ ID NO: 377) and 700-10-03 5'-ctt-ctc-tca-tcc-gcc-aaa-aca-gcc-3' (SEQ ID NO:343), and primers 158-084-01 5'-ctc-ctc-cac-gag-ttc-ggc-3' (SEQ ID NO:310) and 785-73-08 5'-ccg-atg-gag-cct-ctc-cga-3' (SEQ ID NO: 378). The two products were combined and amplified with outside primers 700-10-03 and 158-084-01. The recombinant PCR product was cut with the restriction enzymes NotI and BamHI and ligated into the NotI/BamHI pre-cut TthAKK construct. This mutant was termed TthAKK(N417K/L418K) (DNA sequence SEQ ID NO: 379; amino acid sequence SEQ ID NO: 380).

Construction of Additional TthAKK Point Mutants by Site-Directed Mutagenesis

Construction of TthAKK(P255L)

Site specific mutagenesis was performed on the TthAKK construct using the mutagenic primer 886-049-05 and 886-049-06: 5'-gtg-cgc-acc-gac-ctc-ctc-ctg-gag-gtg-gac-ctc-3' (SEQ ID NO: 381), 5'-gag-gtc-cac-ctc-cag-gag-gag-gtc-ggt-gcg-cac-3' (SEQ ID NO: 382) to generate TthAKK(P255L) (DNA sequence SEQ ID NO: 383; amino acid sequence SEQ ID NO: 384).

Construction of TthAKK(F311Y)

Site specific mutagenesis was performed on the TthAKK construct using the mutagenic primer 886-049-09 and 886-049-10: 5'-ggg-gcc-ttc-gtg-ggc-tac-gtc-ctc-tcc-cgc-ccc-3' (SEQ ID NO: P385), 5'-ggg-gcg-gga-gag-gac-gta-gcc-cac-gaa-ggc-ccc-3' (SEQ ID NO: 386) to generate TthAKK (F311Y) (DNA sequence SEQ ID NO: 387; amino acid sequence SEQ ID NO: 388).

Construction of TthAKK(N221H/R224Q)

Site specific mutagenesis was performed on the TthAKK construct using the mutagenic primer 886-049-01 and 886-049-02: 5'-gaa-aac-ctc-ctc-aag-cac-ctg-gac-cag-gta-aag-cca-gaa-aac-3' (SEQ ID NO: 389), 5'-gtt-ttc-tgg-ctt-tac-ctg-gtc-cag-gtg-ctt-gag-gag-gtt-ttc-3' (SEQ ID NO: 390) to generate TthAKK(N221H/R224Q) (DNA sequence SEQ ID NO: 391; amino acid sequence SEQ ID NO: 392).

Construction of TthAKK(R251H)

Site specific mutagenesis was performed on TthAKK construct using the mutagenic primer 886-049-03 and 886-049-04: 5'-gag-ctc-tcc-cgg-gtg-cac-acc-gac-ctc-ccc-ctg-3' (SEQ ID NO: 393), 5'-cag-ggg-gag-gtc-ggt-gtg-cac-ccg-gga-gag-ctc-3' (SEQ ID NO: 394) to generate TthAKK (R251H) (DNA sequence SEQ ID NO: 395; amino acid sequence SEQ ID NO: 396).

Construction of TthAKK(P255L/R251H)

Site specific mutagenesis was performed on the TthAKK (P255L) construct using the mutagenic primer 886-088-01 and 886-088-02: 5'-gag-ctc-tcc-cgg-gtg-cac-acc-gac-ctc-ctc-ctg-3' (SEQ ID NO: 397), 5'-cag-gag-gag-gtc-ggt-gtg-cac-ccg-gga-gag-ctc-3' (SEQ ID NO: 398) to generate TthAKK(P255L/R251H) (DNA sequence SEQ ID NO: 399; amino acid sequence SEQ ID NO: 400).

Construction of Tth AKK L429V (DNA Sequence SEQ ID NO: 401; Amino Acid Sequence SEQ ID NO: 402)

Palm region randomization mutagenesis was performed on the Tth AKK construct using the mutagenic primer 680-79-02 5'-ctc cat cgg aac ctc ctt [aag cgc ctc gag ggg gag gag aag ctc ctt tgg] ctc tac cac gag gtg-3' (SEQ ID NO: 403) and reverse primer 680-79-04 5'-AAG GAG GTT CCG ATG GAG-3' (SEQ ID NO: 404) to introduce the random mutations in the Palm region. Brackets indicate a synthesis of 91% base shown and 3% all other bases.

Construction of Tth AKK E425V (DNA Sequence SEQ ID NO: 405; Amino Acid Sequence SEQ ID NO: 406)

Palm region randomization mutagenesis was performed on the Tth AKK construct using the mutagenic primer 680-79-02 5'-ctc cat cgg aac ctc ctt [aag cgc ctc gag ggg gag gag aag ctc ctt tgg] ctc tac cac gag gtg-3' (SEQ ID NO: 403) and reverse primer 680-79-04 5'-AAG GAG GTT CCG ATG GAG-3' (SEQ ID NO: 404) to introduce the random mutations in the Palm region. Brackets indicate a synthesis of 91% base shown and 3% all other bases.

Construction of Tth AKK L422N/E425K (DNA Sequence SEQ ID NO: 407; Amino Acid Sequence SEQ ID NO: 408)

Palm region randomization mutagenesis was performed on the Tth AKK construct using the mutagenic primer 680-79-02 5'-ctc cat cgg aac ctc ctt [aag cgc ctc gag ggg gag gag aag ctc ctt tgg] ctc tac cac gag gtg-3' (SEQ ID NO: 403) and reverse primer 680-79-04 5'-AAG GAG GTT CCG ATG GAG-3' (SEQ ID NO: 404) to introduce the random mutations in the Palm region. Brackets indicate a synthesis of 91% base shown and 3% all other bases.

Construction of Tth AKK L422F/W430C (DNA Sequence SEQ ID NO: 409; Amino Acid Sequence SEQ ID NO: 410)

Palm region randomization mutagenesis was performed on Tth AKK DNA using the mutagenic primer 680-79-02 5'-ctc cat cgg aac ctc ctt [aag cgc ctc gag ggg gag gag aag ctc ctt tgg] ctc tac cac gag gtg-3' (SEQ ID NO: 403) and reverse primer 680-79-04 5'-AAG GAG GTT CCG ATG GAG-3' (SEQ ID NO: 404) to introduce the random mutations in the Palm region. Brackets indicate a synthesis of 91% base shown and 3% all other bases.

Construction of Tth AKK A504F (DNA Sequence SEQ ID NO: 411; Amino Acid Sequence SEQ ID NO: 412)

Site saturation mutagenesis was performed on Tth AKK construct using the mutagenic primer 680-80-03 5'-cag gag ctt agg ctt ccc nnn ttg aag aag acg aag aag aca-3' (SEQ ID NO: 413) and reverse primer 680-80-06 5'-cct aag ctc gtc aaa gag-3' (SEQ ID NO: 414) to introduce the random mutations in the A504 amino acid.

Construction of Tth AKK A504V (DNA Sequence SEQ ID NO: 415; Amino Acid Sequence SEQ ID NO: 416)

Site saturation mutagenesis was performed on Tth AKK construct using the mutagenic primer 680-80-03 5'-cag gag ctt agg ctt ccc nnn ttg aag aag acg aag aag aca-3' (SEQ ID NO: 413) and reverse primer 680-80-06 5'-cct aag ctc gtc aaa gag-3' (SEQ ID NO: 414) to introduce the random mutations in the A504 amino acid.

Construction of Tth AKK A504S (DNA Sequence SEQ ID NO: 417; Amino Acid Sequence SEQ ID NO: 418)

Site saturation mutagenesis was performed on Tth AKK construct using the mutagenic primer 680-80-03 5'-cag gag ctt agg ctt ccc nnn ttg aag aag acg aag aag aca-3' (SEQ ID NO: 413) and reverse primer 680-80-06 5'-cct aag ctc gtc aaa gag-3' (SEQ ID NO: 414) to introduce the random mutations in the A504 amino acid.

Construction of Tth AKK S517G (DNA Sequence SEQ ID NO: 419; Amino Acid Sequence SEQ ID NO: 420)

Site saturation mutagenesis was performed on Tth AKK construct using the mutagenic primer 680-80-07 5'-GGC AAG CGC TCC ACC NNN GCC GCG GTG CTG GAG GCC CTA CGG-3' (SEQ ID NO: 421) and reverse primer 680-80-10 5'-GGT GGA GCG CTT GCC-3' (SEQ ID NO: 422) to introduce the random mutations in the S517 amino acid.

Construction of Tth AKK A518L (DNA Sequence SEQ ID NO: 423; Amino Acid Sequence SEQ ID NO: 424)

Site saturation mutagenesis was performed on Tth AKK construct using the mutagenic primer 680-80-07 5'-GGC AAG CGC TCC ACC AGC NNN GCG GTG CTG GAG GCC CTA CGG-3' (SEQ ID NO: 425) and reverse primer 680-80-10 5'-GGT GGA GCG CTT GCC-3' (SEQ ID NO:422) to introduce the random mutations in the A518 amino acid.

Construction of Tth AKK A518R (DNA Sequence SEQ ID NO: 426; Amino Acid Sequence SEQ ID NO: 427)

Site saturation mutagenesis was performed on Tth AKK construct using the mutagenic primer 680-80-07 5'-GGC AAG CGC TCC ACC AGC NNN GCG GTG CTG GAG GCC CTA CGG-3' (SEQ ID NO: 425) and reverse primer 680-80-10 5'-ggt gga gcg ctt gcc-3' (SEQ ID NO: 422) to introduce the random mutations in the A518 amino acid.

Construction of Taq5M L451R (DNA Sequence SEQ ID NO: 428; Amino Acid Sequence SEQ ID NO: 429)

Site directed mutagenesis was performed on the Taq 5M construct using the mutagenic primer 240-60-05 5'-acg-ggg-gtg-cgc-cgg-gac-gtg-gcc-tat 3' (SEQ ID NO: 430) to introduce the L451R mutation in the Taq 5M enzyme.

Construction of Tth AKK A504K (DNA Sequence SEQ ID NO: 431; Amino Acid Sequence SEQ ID NO: 432)

Site directed mutagenesis was performed on the Tth AKK construct using the mutagenic primer 680-69-04 5'-ctt agg ctt ccc aag ttg aag aag acg aag aag aca-3' (SEQ ID NO: 433) and reverse primer 680-69-05 5'-tgt ctt ctt cgt ctt ctt caa ctt ggg aag cct aag-3' (SEQ ID NO: 434) to introduce the A504K mutation in the Tth AKK enzyme.

Construction of Tth AKK H641A (DNA Sequence SEQ ID NO: 435; Amino Acid Sequence SEQ ID NO: 436)

Site directed mutagenesis was performed on Tth AKK construct using the mutagenic primer 680-69-08 5'-gag ggg aag gac atc gcc acc cag acc gca agc-3' (SEQ ID NO: 437) and reverse primer 583-01-02 5'-gct tgc ggt ctg ggt ggc gat gtc ctt ccc ctc-3' (SEQ ID NO: 438) to introduce the H641A mutation in the Tth AKK enzyme.

Construction of Tth AKK T508P (DNA Sequence SEQ ID NO: 439; Amino Acid Sequence SEQ ID NO: 440)

Site directed mutagenesis was performed on TthAKK construct using the mutagenic primer 680-70-01 5'-ccc-gcc ttg aag aag ccg aag aag aca ggc aag-3' (SEQ ID NO: 441) and reverse primer 680-70-02 5'-ctt gcc tgt ctt ctt cgg ctt ctt caa ggc ggg-3' (SEQ ID NO: 442) to introduce the T508P mutation in the Tth AKK enzyme.

Chimeras and Mutations in Chimeras.

Fusion between TthAKK Enzyme and Alpha-Peptide

A TthAKK-lacZ-alpha-peptide chimeric fusion was constructed to allow detection of mutations (including frameshifts, deletions, insertions, etc.) which cause the inability of expression of the full-length fusion protein based on the colony blue-white screening (Wu et al., Nucleic Acids Research, 24:1710 [1996]).

Site specific mutagenesis was performed on TthAKK DNA using the mutagenic primers 959-041-03, 5'-cac-cac-cac-cac-cac-cac-cac-gtc-gac-tag-tgc-tag-cgt-cga-cta-gct-gca-ggc-atg-caa-gt-tgg-c-3' (SEQ ID NO: 477) and 959-041-04, 5'-gcc-aag-ctt-gca-tgc-ctg-cag-cta-gtc-gac-gct-agc-act-agt-cga-cgt-ggt-ggt-ggt-ggt-ggt-g-3' (SEQ ID NO: 478) to generate pTthAKK-L with SalI site following the 6×His tag at the C-terminus of TthAKK for the insertion of lacZ alpha peptide. The alpha peptide (of 201 amino acids) was first PCR amplified from the pCRII-TOPO vector (Invitrogen) with primers 959-041-01, 5'-cag-gaa-gcg-gcc-gcg-tcg-aca-tga-cca-tga-tta-cgc-caa-gc-3' (SEQ ID NO: 479) and 959-093-01, 5'-ggg-ccc-gcc-agg-gtc-gac-tca-ggg-cga-tgg-ccc-act-acg-tga-3' (SEQ ID NO: 480). The PCR product was then digested with restriction enzyme SalI and ligated into the pTthAKK-L vector, which was also cut with the same enzyme to generate the chimeric construct TthAKK-alpha peptide (DNA sequence SEQ ID NO: 481; amino acid sequence SEQ ID NO: 482). The orientation of the insert was confirmed by sequencing.

Construction of TthTscAKK and TthTfiAKK Enzymes

The TthAKK construct was cut with the enzymes EcoRI and NotI and the smaller insert fragment was gel isolated. The TscAKK or TfiAKK constructs were also cut with EcoRI and NotI and the larger fragment was gel isolated and purified. The Tth insert (nuclease domain) was ligated into the TscAKK and TfiAKK vectors (polymerase domain) to generate TthTscAKK (DNA sequence SEQ ID NO: 447; amino acid sequence SEQ ID NO: 448) and TthTfiAKK (DNA sequence SEQ ID NO: 449; amino acid sequence SEQ ID NO: 450) chimeric constructs.

FT Mutations of Tth Polymerase to Improve Substrate Specificity Construction of Taq(FT)TthAKK Site specific mutagenesis was performed on the TaqTthAKK construct using the mutagenic primer 473-087-05: 5'-cgg-gac-ctc-gag-gcg-cgt-gaa-ccc-cag-gag-gtc-cac-3' (SEQ ID NO: 483) to introduce the L107F/A108T mutations and generate Taq(FT)TthAKK (DNA sequence SEQ ID NO: 484; amino acid sequence SEQ ID NO: 485).

Construction of Tfi(FT)TthAKK

Site specific mutagenesis was performed on the TfiTthAKK construct using the mutagenic primers 785-096-01: 5'-gtg-gac-ctt-ctg-ggc-ttt-acc-cgc-ctc-gag-gcc-ccg-3' (SEQ ID NO: 486) and 785-096-02: 5'-cgg-ggc-ctc-gag-gcg-ggt-aaa-gcc-cag-aag-gtc-cac-3' (SEQ ID NO: 487) to introduce the L107F/V108T mutations and generate Tfi(FT)TthAKK (DNA sequence SEQ ID NO: 349; amino acid sequence SEQ ID NO: 488).

Tfi(FT) DN 2M(N) and Tsc(FT) DN 2M(N) Mutants

The L107F/V108T mutations were introduced by isolating the NotI and SalI fragment of the Tfi DN 2M(N) mutant (DNA sequence SEQ ID NO: 345) and inserting it into a NotI-SalI pre-digested Tfi(FT)TthAKK (DNA sequence SEQ ID NO: 349; amino acid sequence SEQ ID NO: 488) to yield the Tfi(FT) DN 2M(N) mutant (DNA sequence SEQ ID NO: 350, amino acid sequence SEQ ID NO: 351). To add the L107F or the E108T mutations into this Tsc-based construct, an identical procedure was done. The NotI and SalI cut fragment of Tsc DN 2M(N) mutant (DNA sequence SEQ ID NO: 348) was inserted into NotI-SalI pre-digested Tsc(FT)TthAKK (DNA sequence SEQ ID NO: 491) vector to yield Tsc(FT) DN 2M(N) mutant (DNA sequence SEQ ID NO: 352, amino acid sequence SEQ ID NO: 353).

Construction of Tfi(FT) AKK and Tsc(FT) AKK

Starting with the Tfi(FT)DN2M(N) construct described previously (DNA sequence SEQ ID NO: 350), primers (959-022-01 to -04: 5'-ggc-ctc-acc-ccg-gtg-aag-cgg-acg-aag-aag-acg-ggc-aag-cgc-3', 5'-gcg-ctt-gcc-cgt-ctt-ctt-cgt-ccg-ctt-cac-cgg-ggt-gag-gcc-3', 5'-ctc-ctc-ctc-caa-gtg-gcc-aac-gag-ctg-gtc-ctg-3', 5'-cag-gac-cag-ctc-gtt-ggc-cac-ttg-gag-gag-gag-3' (SEQ ID NO: 354–357) were used to introduce the "AKK" set of mutations (H784A, G504K and E507K) by site specific mutagenesis. The resulting mutant construct is termed Tfi(FT)AKK (DNA sequence SEQ ID NO:366, amino acid sequence SEQ ID NO:367).

Likewise, primers 959-022-05 to -08: 5'-ggg-ctt-ccc-gcc-atc-aag-aag-acg-aag-aag-acg-ggc-aag-cgc-3', 5'-gcg-ctt-gcc-cgt-ctt-ctt-cgt-ctt-ctt-gat-ggc-ggg-aag-ccc-3', 5'-atg-ctt-ttg-cag-gtg-gcc-aac-gaa-ctg-gtc-ctc-3', 5'-gag-gac-cag-ttc-gtt-ggc-cac-ctg-caa-aag-cat-3' (SEQ ID NO: 360–363) were used in a site specific mutagenesis reaction, with the Tsc (FT)DN2M(N) mutant (DNA sequence SEQ ID NO: 352) as template to generate the Tsc(FT)AKK mutant (DNA sequence SEQ ID NO: 368; amino acid sequence SEQ ID NO: 369).

Construction of Tsc(FT)TthAKK

Site specific mutagenesis was performed on the TscTthAKK construct using the mutagenic primers 785-008-03 5'-ttt-acc-cgc-ctc-gag-gtg-ccg-ggc-3' (SEQ ID NO: 489) and reverse primer 680-21-03 5'-cgg cac ctc gag gcg ggt aaa gcc caa aag gtc cac-3' (SEQ ID NO: 490) to introduce the L107F/E108T mutations and generate Tsc(FT)TthAKK (DNA sequence SEQ ID NO: 454; amino acid sequence SEQ ID NO: 491).

Construction of Taq(FT)TscAKK and Taq(FT)TfiAKK Enzymes

The Taq(FT)TthAKK construct was cut with the enzymes EcoRI and NotI and the smaller insert fragment was gel isolated. The TscAKK or TfiAKK constructs were also cut with EcoRI and NotI and the larger fragment was gel isolated and purified. The Taq(FT) insert (nuclease domain) was ligated into the TscAKK and TfiAKK vectors (polymerase domain) to generate the Taq(FT)TscAKK (DNA sequence SEQ ID NO: 443; amino acid sequence SEQ ID NO: 444) and Taq(FT)TfiAKK (DNA sequence SEQ ID NO: 445; amino acid sequence SEQ ID NO: 446) chimeric constructs.

Construction of TaqEFT-Tth(AKK) (DNA Sequence SEQ ID NO:501; Amino Acid Sequence SEQ ID NO: 502)

Site specific mutagenesis was performed on Taq(FT)-Tth (AKK) DNA (SEQ ID NO: 484) using the mutagenic primers 436-013-08: 5'-atc-gtg-gtc-ttt-gac-gcc-gag-gcc-ccc-tcc-ttc-c-3' (SEQ ID NO:503) and 436-013-09 5'-gga-agg-agg-ggg-cct-cgg-cgt-caa-aga-cca-cga-t-3' (SEQ ID NO:504) to introduce the K70E mutation.

Additional Mutations to Improve Enzyme Activity of Taq (EFT)TthAKK

Construction of TaqEFT-Tth(AKK)-A/M1 (DNA Sequence SEQ ID NO:505; Amino Acid Sequence SEQ ID NO: 506)

Site specific mutagenesis was performed on Taq(EFT)-Tth(AKK) DNA (SEQ ID NO: 501) using the mutagenic primers 1044-038-01: 5'-cag-acc-atg-aat-tcg-gag-gcg-atg-ctg-ccc-ctc-ttt-3' (SEQ ID NO:507) and 1044-038-02: (SEQ ID NO: 508) 5'-aaa-gag-ggg-cag-cat-cgc-ctc-cga-att-cat-ggt-ctg-3' to introduce the G4EA mutation.

Construction of TaqEFT-Tth(AKK)-B/M2 (DNA Sequence SEQ ID NO:509; Amino Acid Sequence SEQ ID NO: 510)

Site specific mutagenesis was performed on Taq(EFT)-Tth(AKK) DNA (SEQ ID NO: 501) using the mutagenic primers 1044-038-03: 5'-gcc-tac-cgc-acc-ttc-ttt-gcc-ctg-aag-ggc-ctc-3 and 1044-038-04: 5'-gag-gcc-ctt-cag-ggc-aaa-gaa-ggt-gcg-gta-ggc-3' (SEQ ID NO: 511 and 512, respectively) to introduce the H29F mutation.

Construction of TaqEFT-Tth(AKK)-C/M3 (DNA Sequence SEQ ID NO:513; Amino Acid Sequence SEQ ID NO: 514)

Site specific mutagenesis was performed on Taq(EFT)-Tth(AKK) DNA (SEQ ID NO: 501) using the mutagenic primers 1044-038-05: 5'-ctc-ctc-aag-gcc-ctc-aga-gag-gac-ggg-gac-gcg-3' and 1044-038-06: 5'-cgc-gtc-ccc-gtc-ctc-tct-gag-ggc-ctt-gag-gag-3' (SEQ ID NO: 515 and 516, respectively) to introduce the K57R mutation.

Construction of TaqEFT-Tth(AKK)-D/M5 (DNA Sequence SEQ ID NO:517; Amino Acid Sequence SEQ ID NO:518)

Site specific mutagenesis was performed on Taq(EFT)-Tth(AKK) DNA (SEQ ID NO: 501) using the mutagenic primers 1044-038-09: 5'-gac-gac-gtc-ctg-gcc-acc-ctg-gcc-aag-aag-gcg-3' and 1044-038-10: 5'-cgc-ctt-ctt-ggc-cag-ggt-ggc-cag-gac-gtc-gtc-3' (SEQ ID NO: 519 and 520, respectively) to introduce the S125T mutation.

Construction of TaqEFT-Tth(AKK)-E/M6 (DNA Sequence SEQ ID NO:521; Amino Acid Sequence SEQ ID NO: 522)

Site specific mutagenesis was performed on Taq(EFT)-Tth(AKK) DNA (SEQ ID NO: 501) using the mutagenic primers 1044-038-11: 5'-ggg-gag-aag-acg-gcg-ctc-aag-ctt-ctg-gag-gag-3' and 1044-038-12: 5'-ctc-ctc-cag-aag-ctt-gag-cgc-cgt-ctt-ctc-ccc-3' (SEQ ID NO: 523 and 524, respectively) to introduce the R206L mutation.

Construction of TaqEFT-Tth(AKK)-F/M7 (DNA Sequence SEQ ID NO:525; Amino Acid Sequence SEQ ID NO: 526)

Site specific mutagenesis was performed on Taq(EFT)-Tth(AKK) DNA (SEQ ID NO: 501) using the mutagenic primers 1044-038-13: 5'-gag-ccc-gac-cgg-gag-ggg-ctt-aag-gcc-ttt-ctg-gag-agg-3' and 1044-038-14: 5'-cct-ctc-cag-aaa-ggc-ctt-aag-ccc-ctc-ccg-gtc-ggg-ctc-3 (SEQ ID NO: 527 and 528, respectively) to introduce the R269G and R271K mutations.

Construction of TaqEFT-Tth(AKK)-G/M8 (DNA Sequence SEQ ID NO:529; Amino Acid Sequence SEQ ID NO: 530)

Site specific mutagenesis was performed on Taq(EFT)-Tth(AKK) DNA (SEQ ID NO: 501) using the mutagenic primers 1044-038-15: 5'-cac-gag-ttc-ggc-ctt-ctg-gga-ggg-gag-aag-ccc-cgg-gag-gag-gcc-ccc-tgg-ccc-3' and 1044-038-16: 5'-ggg-cca-ggg-ggc-ctc-ctc-ccg-ggg-ctt-ctc-ccc-tcc-cag-aag-gcc-gaa-ctc-gtg-3' (SEQ ID NO: 531 and 532, respectively) to introduce the E290G, S291G, P292E, A294P, and L295R mutations.

Construction of TaqEFT-Tth(AKK)-H/M9 (DNA Sequence SEQ ID NO:533; Amino Acid Sequence SEQ ID NO: 534)

Site specific mutagenesis was performed on Taq(EFT)-Tth(AKK) DNA (SEQ ID NO: 501) using the mutagenic primers 1044-038-17: 5'-ctg-gcc-ctg-gcc-gcc-tgc-agg-ggc-ggc-cgc-gtg-3' and 1044-038-18: 5'-cac-gcg-gcc-gcc-cct-ga-ggc-ggc-cag-ggc-cag-3' (SEQ ID NO: 535 and 536, respectively) to introduce the A328C mutation.

Construction of TaqEFT-Tth(AKK)-I/M10 (DNA Sequence SEQ ID NO:537; Amino Acid Sequence SEQ ID NO: 538)

Site specific mutagenesis was performed on Taq(EFT)-Tth(AKK) DNA (SEQ ID NO: 501) using the mutagenic primers 1080-015-01 (SEQ ID NO:539) 5'-ggg gag aag acg gcg agg aag ctt ctg aag gag tgg ggg agc-3' and 1080-015-02 (SEQ ID NO: 540) 5'-gct ccc cca ctc ctt cag aag ctt cct cgc cgt ctt ctc ccc-3' to introduce the E210 K mutation.

Construction of TaqEFT-Tth(AKK)-M1–9 (DNA Sequence SEQ ID NO:541; Amino Acid Sequence SEQ ID NO: 542)

Seven independent PCR reactions were performed, using construct TaqEFT-Tth(AKK) (SEQ ID: 501) as a template, with the following pairs of mutagenic primers: PCR Reaction 1; 1044-038-01 5'-cag-acc-atg-aat-tcg-gag-gcg-atg-ctg-ccc-ctc-ttt-3' (SEQ ID NO:507) and 1044-038-04 5'-gag-gcc-ctt-cag-ggc-aaa-gaa-ggt-gcg-gta-ggc-3' (SEQ ID NO:512) to yield a 108 base pair fragment, PCR Reaction 2; 1044-038-03 5'-gcc-tac-cgc-acc-ttc-ttt-gcc-ctg-aag-ggc-ctc-3' (SEQ ID NO: 511) and 1044-038-06 5'-cgc-gtc-ccc-gtc-ctc-tct-gag-ggc-ctt-gag-gag-3' (SEQ ID NO: 516) to yield a 117 base pair fragment, PCR Reaction 3; 1044-038-05 5'-ctc-ctc-aag-gcc-ctc-aga-gag-gac-ggg-gac-gcg-3' (SEQ ID NO: 515) and 1044-038-10 5'-cgc-ctt-ctt-ggc-cag-ggt-ggc-cag-gac-gtc-gtc-3' (SEQ ID NO: 520) to yield a 237 base pair fragment, PCR Reaction 4; 1044-038-09 5'-gac-gac-gtc-ctg-gcc-acc-ctg-gcc-aag-aag-gcg-3' (SEQ ID NO: 519) and 1044-038-12 5'-ctc-ctc-cag-aag-ctt-gag-cgc-cgt-ctt-ctc-ccc-3' (SEQ ID NO: 524) to yield a 276 base pair fragment, PCR Reaction 5; 1044-038-11 5'-ggg-gag-aag-acg-gcg-ctc-aag-ctt-ctg-gag-gag-3' (SEQ ID NO: 523) and 1044-038-14 5'-cct-ctc-cag-aaa-ggc-ctt-aag-ccc-ctc-ccg-gtc-ggg-ctc-3' (SEQ ID NO: 528) to yield a 228 base pair fragment, PCR Reaction 6; 1044-038-13 5'-gag-ccc-gac-gg-gag-ggg-ctt-aag-gcc-ttt-ctg-gag-agg-3' (SEQ ID NO: 527) and 1044-038-16 5'-ggg-cca-ggg-ggc-ctc-ctc-ccg-ggg-ctt-ctc-ccc-tcc-cag-aag-gcc-gaa-ctc-gtg-3' (SEQ ID NO: 532) to yield a 113 base pair fragment, PCR Reaction 7; 1044-038-15 5'-cac-gag-ttc-ggc-ctt-ctg-gga-ggg-gag-aag-ccc-cgg-gag-gag-gcc-ccc-tgg-ccc-3' (SEQ ID NO: 531) and 1044-038-18 5'-cac-gcg-gcc-gcc-cct-gca-ggc-cag-ggc-cag-3' (SEQ ID NO: 536) to yield a 157 base pair fragment. The seven PCR products overlap such that PCR amplification in the absence of primers yielded the appropriate 1005 base pair product to introduce the K70E, G4EA, H29F, K57R, S125T, R206L, R269G, R271K, E290G, S291G, P292E, A294P, L295R, and A328C mutations. The product was further amplified using the outside primers: 1044-038-1 (SEQ ID NO: 507) and 1044-038-18 (SEQ ID NO: 536) and cloned into pPCR-Script-Amp. From this construct, the nuclease domain was again amplified using primers: 1044-038-1 (SEQ ID NO: 507) and 1044-038-18 (SEQ ID NO: 536) and digested with EcoRI and NotI. The digested PCR product was ligated into an EcoRI and NotI digested TaqEFT-Tth(AKK) construct and transformed into JM 109 for protein expression and screening.

Construction of TaqEFT-Tth(AKK)-M1–10 (DNA Sequence SEQ ID NO:543; Amino Acid Sequence SEQ ID NO: 544)

Seven independent PCR reactions were performed, using construct TaqEFT-Tth(AKK) (SEQ ID: 501) as a template, with the following pairs of mutagenic primers: PCR Reaction 1; 1044-038-01 5'-cag-acc-atg-aat-tcg-gag-gcg-atg-ctg-ccc-ctc-ttt-3' (SEQ ID NO:507) and 1044-038-04 5'-gag-gcc-ctt-cag-ggc-aaa-gaa-ggt-gcg-gta-ggc-3' (SEQ ID NO:512) to yield a 108 base pair fragment, PCR Reaction 2; 1044-038-03 5'-gcc-tac-cgc-acc-ttc-ttt-gcc-ctg-aag-ggc-ctc-3' (SEQ ID NO: 511) and 1044-038-06 5'-cgc-gtc-ccc-gtc-ctc-tct-gag-ggc-ctt-gag-gag-3' (SEQ ID NO: 516) to yield a 117 base pair fragment, PCR Reaction 3; 1044-038-05 5'-ctc-ctc-aag-gcc-ctc-aga-gag-gac-ggg-gac-gcg-3' (SEQ ID NO: 515) and 1044-038-10 5'-cgc-ctt-ctt-ggc-cag-ggt-ggc-cag-gac-gtc-gtc-3' (SEQ ID NO: 520) to yield a 237 base pair fragment, PCR Reaction 4; 1044-038-09 5'-gac-gac-gtc-ctg-gcc-acc-ctg-gcc-aag-aag-gcg-3' (SEQ ID NO: 519) and 1080-42-02 5'-gc ttc cag gct ccc cca ctc ctt cag aag ctt gag cgc cgt ctt ctc ccc-3' (SEQ ID NO: 546) to yield a 299 base pair fragment, PCR Reaction 5; 1080-42-01 5'-ggg gag aag acg gcg ctc agg ctt ctg aag gag tgg ggg agc ctg gaa gc-3' (SEQ ID NO: 545) and 1044-038-14 5'-cct-ctc-cag-aaa-ggc-ctt-aag-ccc-ctc-ccg-gtc-ggg-ctc-3' (SEQ ID NO: 528) to yield a 228 base pair fragment, PCR Reaction 6; 1044-038-13 5'-gag-ccc-gac-cgg-gag-ggg-ctt-aag-gcc-ttt-ctg-gag-agg-3' (SEQ ID NO: 527) and 1044-038-16 5'-ggg-cca-ggg-ggc-ctc-ctc-ccg-ggg-ctt-ctc-ccc-tcc-cag-aag-gcc-gaa-ctc-gtg-3' (SEQ ID NO: 532) to yield a 113 base pair fragment, PCR Reaction 7; 1044-038-15 5'-cac-gag-ttc-ggc-ctt-ctg-gga-ggg-gag-aag-ccc-cgg-gag-gag-gcc-ccc-tgg-ccc-3' (SEQ ID NO: 531) and 1044-038-18 5'-cac-gcg-gcc-gcc-cct-gca-ggc-ggc-cag-ggc-cag-3' (SEQ ID NO: 536) to yield a 157 base pair fragment. The seven PCR products overlap such that PCR amplification in the absence of primers yielded the appropriate 1005 base pair product to introduce the K70E, G4EA, H29F, K57R, S125T, R206L, E210K, R269G, R271K, E290G, S291G, P292E, A294P, L295R, and A328C mutations. The product was further amplified using the outside primers: 1044-038-1 (SEQ ID NO: 507) and 1044-038-18 (SEQ ID NO: 536) and cloned into pPCR-Script-Amp. From this construct, the nuclease domain was again amplified using primers: 1044-038-1 (SEQ ID NO: 507) and 1044-038-18 (SEQ ID NO: 536) and digested with EcoRI and NotI. The digested PCR product was ligated into an EcoRI and NotI digested TaqEFT-Tth(AKK) construct and transformed into JM109 for enzyme expression and screening.

K69E Mutation of FEN Enzymes to Further Improve Substrate Specificity

Construction of Tth(K69E)AKK, Taq(K69E)TthAKK, Tfi(K69E)TthAKK and Tsc(K69E)TthAKK and Mutants Site specific mutagenesis was performed on TthAKK, TaqTthAKK, TfiTthAKK and TscTthAKK DNAs using the mutagenic primers 5'-atc-gtg-gtc-ttt-gac-gcc-gag-gcc-ccc-tcc-ttc-c-3' (SEQ ID NO: 492) and 5'-gga-agg-agg-ggg-cct-cgg-cgt-caa-aga-cca-cga-t-3' (SEQ ID NO: 493) to introduce the K69E mutation and to generate Tth(K69E)AKK (DNA sequence SEQ ID NO: 452; amino acid sequence SEQ ID NO: 494), Taq(K69E)ThAKK, (DNA sequence SEQ ID NO: 495; amino acid sequence SEQ ID NO: 496), Tfi(K69E)TthAKK (DNA sequence SEQ ID NO: 497; amino acid sequence SEQ ID NO: 498) and Tsc(K69E)TthAKK (DNA sequence SEQ ID NO: 499; amino acid sequence SEQ ID NO: 500) mutant enzymes.

Construction of Tsc(167–334)TthAKK

Two overlapping PCR fragments were generated by primers 390-76-08: 5'-tgt-gga-att-gtg-agc-gg-3' (SEQ ID NO:314) and 1044-041-01: 5'-ctt-ctc-tca-tcc-gcc-aaa-aca-gcc-3' (SEQ ID NO: 451) with template Tth(K69E)AKK, (DNA sequence SEQ ID NO: 452), and primers 1044-041-02: 5'-ctc-ctc-cac-gag-ttc-ggc-3' (SEQ ID NO: 453) and 209-074-02: 5'-gtg-gcc-tcc-ata-tgg-gcc-agg-ac-3' (SEQ ID NO:316) with template Tsc(K69E)TthAKK, (DNA sequence SEQ ID NO: 454). Two products were combined and amplified with outside primers 390-76-08 and 209-074-02. The recombinant PCR product was cut with the restriction enzymes EcoRI and NotI and ligated into the vector TthAKK which was prepared by cutting with the same enzymes to yield Tsc(167–333)TthAKK construct (DNA sequence SEQ ID NO: 455; amino acid sequence SEQ ID NO: 456).

Construction of Tsc(222–334)TthAKK

Two overlapping PCR fragments were generated by primers 390-76-08: 5'-tgt-gga-att-gtg-agc-gg-3' (SEQ ID NO:314) and 1044-041-03: 5'-ttc-cag-gtg-ctt-gag-gag-gtt-ttc-cag-3' (SEQ ID NO: 457) with template Tth(K69E)AKK (DNA sequence SEQ ID NO: 452), and primers 1044-041-04: 5'-ctc-ctc-aag-cac-ctg-gaa-cag-gtg-aaa-3' (SEQ ID NO: 458) and 209-074-02: 5'-gtg-gcc-tcc-ata-tgg-gcc-agg-ac-3' (SEQ ID NO:316) with template Tsc(K69E)TthAKK, (DNA sequence SEQ ID NO: 454). Two products were combined and amplified with outside primers 390-76-08 and 209-074-02. The recombinant PCR product was cut with the restriction enzymes EcoRI and NotI and ligated into the vector TthAKK which was prepared by cutting with the same enzymes to yield Tsc(222–334)TthAKK construct (DNA sequence SEQ ID NO: 459; amino acid sequence SEQ ID NO: 460).

Construction of Tfi(222–334)TthAKK

Two overlapping PCR fragments were generated by primers 390-76-08: 5'-tgt-gga-att-gtg-agc-gg-3' (SEQ ID NO:314) and 1044-058-05: 5'-gtc-cag-gtt-ctt-gag-gag-gtt-ttc-cag-3' (SEQ ID NO: 461) with template Tth(K69E)AKK (DNA sequence SEQ ID NO: 452), and primers 1044-058-06: 5'-ctc-ctc-aag-aac-ctg-gac-cgg-gta-aag-3' (SEQ ID NO: 462) and 209-074-02: 5'-gtg-gcc-tcc-ata-tgg-gcc-agg-ac-3' (SEQ ID NO:316) with template Tfi(K69E)TthAKK (DNA sequence SEQ ID NO: 497). Two products were combined and amplified with outside primers 390-76-08 and 209-074-02. The recombinant PCR product was cut with the restriction enzymes EcoRI and NotI and ligated into the vector TthAKK which was prepared by cutting with the same enzymes to yield Tfi(222–334)TthAKK construct (DNA sequence SEQ ID NO: 463; amino acid sequence SEQ ID NO: 464).

Construction of Tfi(167–334)TthAKK

Two overlapping PCR fragments were generated by primers 390-76-08 5'-tgt-gga-att-gtg-agc-gg-3' (SEQ ID NO:314) and 1044-058-07 5'-gac-gtc-ctt-cgg-ggt-gat-gag-gtg-gcc-3' (SEQ ID NO: 465) with template Tth(K69E) AKK, (DNA sequence SEQ ID NO: 452), and primers 1044-058-08 5'-atc-acc-cg-aag-gac-gtc-cag-gag-aag-3' (SEQ ID NO: 466) and 209-074-02 5'-gtg-gcc-tcc-ata-tgg-gcc-agg-ac-3' (SEQ ID NO:316) with template Tfi(K69E)TthAKK, (DNA sequence SEQ ID NO: 498). Two products were combined and amplified with outside primers 390-76-08 and 209-074-02. The recombinant PCR product was cut with the restriction enzymes EcoRI and NotI and ligated into the vector TthAKK which was prepared by cutting with the same enzymes to yield Tfi(167–333)TthAKK construct (DNA sequence SEQ ID NO: 467; amino acid sequence SEQ ID NO: 468).

Construction of Tsc(111–334)TthAKK

Two overlapping PCR fragments were generated by primers 390-76-08 5'-tgt-gga-att-gtg-agc-gg-3' (SEQ ID NO:314) and 1044-058-01 5'-ctc-gag-gcg-ggt-aaa-ccc-cag-gag-gtc-3' (SEQ ID NO: 469) with template Tth(K69E)AKK (DNA sequence SEQ ID NO: 452), and primers 1044-058-02 5'-ggg-ttt-acc-cgc-ctc-gag-gtg-ccc-ggc-3' (SEQ ID NO: 470) and 209-074-02 5'-gtg-gcc-tcc-ata-tgg-gcc-agg-ac-3' (SEQ ID NO:316) with template Tsc(K69E)TthAKK (DNA sequence SEQ ID NO: 499). Two products were combined and amplified with outside primers 390-76-08 and 209-074-02. The recombinant PCR product was cut with the restriction enzymes EcoRI and NotI and ligated into the vector TthAKK which was prepared by cutting with the same enzymes to yield Tsc(167–333)TthAKK construct (DNA sequence SEQ ID NO: 471; amino acid sequence SEQ ID NO: 472).

Construction of Tsc(1–167)TthAKK

Two overlapping PCR fragments were generated by primers 390-76-08 5'-tgt-gga-att-gtg-agc-gg-3' (SEQ ID NO:314) and 1044-058-03 5'-aag-cca-ctc-cgg-ggt-gat-cag-gta-acc-3' (SEQ ID NO: 473) with template Tsc(K69E) TthAKK (DNA sequence SEQ ID NO: 499), and primers 1044-058-04 5'-atc-acc-ccg-gag-tgg-ctt-tgg-gag-aag-3' (SEQ ID NO: 474) and 209-074-02 5'-gtg-gcc-tcc-ata-tgg-gcc-agg-ac-3' (SEQ ID NO:316) with template Tth(K69E) AKK (DNA sequence SEQ ID NO: 452). Two products were combined and amplified with outside primers 390-76-08 and 209-074-02. The recombinant PCR product was cut with the restriction enzymes EcoRI and NotI and ligated into the vector TthAKK which was prepared by cutting with the same enzymes to yield Tsc(1–167)TthAKK construct (DNA sequence SEQ ID NO: 475; amino acid sequence SEQ ID NO: 476).

Modification of AfuFEN Enzymes

Construction of pAfuFEN

Plasmid pAfuFEN1 was prepared as described [U.S. patent application Ser. No. 09/684,938, WO 98/23774, each incorporated herein by reference in their entireties]. Briefly, genomic DNA was prepared from one vial (approximately 5 ml of culture) of live A. fulgidus bacteria from DSMZ (DSMZ #4304) with the DNA XTRAX kit (Gull Laboratories, Salt Lake City, Utah) according to the manufacturer's protocol. The final DNA pellet was resuspended in 100 µl of TE (10 mM Tris HCl, pH 8.0, 1 mM EDTA). One microliter of the DNA solution was employed in a PCR using the ADVANTAGE cDNA PCR kit (Clonetech); the PCR was conducted according to manufacturer's recommendations.

The 5' end primer is complementary to the 5' end of the Afu FEN-1 gene except it has a 1 base pair substitution to create an Nco I site. The 3' end primer is complemetary to the 3' end of the Afu FEN-1 gene downstream from the FEN-1 ORF except it contains a 2 base substitution to create a Sal I site. The sequences of the 5' and 3' end primers are 5'-CCGTCAACATTTACCATGGGTGCGGA-3' (SEQ ID NO:617) and 5'-CCGCCACCTCGTAGTCGACATC-CTTTTCGTG (SEQ ID NO:618), respectively. Cloning of the resulting fragment was as described for the PfuFEN1 gene, U.S. Pat. No. 5,994,069, incorporated herein in its entirety for all purposes, to create the plasmid pTrc99-AFFEN1. For expression, the pTrcAfuHis plasmid was constructed by modifying pTrc99-AFFEN1, by adding a histidine tail to facilitate purification. To add this histidine tail, standard PCR primer-directed mutagenesis methods were used to insert the coding sequence for six histidine residues between the last amino acid codon of the pTrc99-AFFEN1 coding region and the stop codon. The resulting plasmid was termed pTrcAfuHis. The protein was then expressed as described and purified by binding to a Ni++ affinity column.

Construction of Afu(Y236A), A46-5

Two overlapping PCR fragments were generated from template AfuFEN (SEQ ID NO:556) with primers: 785-73-04 5'-ctg-gtc-ggg-acg-gac-gcc-aat-gag-ggt-gtg-aag-3' (SEQ ID NO: 547) and 700-10-03 5'-ctt-ctc-tca-tcc-gcc-aaa-aca-gcc-3' (SEQ ID NO:343), and primers: 390-076-08 5'-tgtgga-att-gtg-agc-gg-3' (SEQ ID NO:314) and 785-73-06 5'-gtc-cgt-ccc-gac-cag-aat-3' (SEQ ID NO: 548). The two products were combined and amplified with outside primers 700-10-03 and 390-076-08. The recombinant PCR product was cut with the restriction enzymes NcoI and SalI and ligated into the AfuFEN construct which was prepared by cutting with the same enzymes to yield the Afu(Y236A) construct (DNA sequence SEQ ID NO: 549; amino acid sequence SEQ ID NO: 550).

Construction of Afu(Y236R), A56-9

Two overlapping PCR fragments were generated using the template AfuFEN with primers: 785-73-05 5'-ctg-gtc-ggg-acg-gac-agg-aat-gag-ggt-gtg-aag-3' (SEQ ID NO: 551) and 700-10-03 5'-ctt-ctc-tca-tcc-gcc-aaa-aca-gcc-3' (SEQ ID NO:343), and primers: 390-076-08 5'-tgt-gga-att-gtg-agc-gg-3' (SEQ ID NO:314) and 785-73-06 5'-gtc-cgt-ccc-gac-cag-aat-3' (SEQ ID NO: 548). The two products were combined and amplified with outside primers 700-10-03 and 390-076-08. The recombinant PCR product was cut with the restriction enzymes NcoI and SalI and ligated into the AfuFEN construct which was prepared by cutting with the same enzymes to yield Afu(Y236R) construct (DNA sequence SEQ ID NO: 552; amino acid sequence SEQ ID NO: 553).

2. Chimeras of FEN Enzymes and *Thermus* Polymerase Derivatives

The following enzyme constructs combine portions of the AfuFEN enzyme polymerase domain and the polymerase domain of *Thermus* ploymerases. These combinations were designed based on information generated by molecular modeling.

Construction of Afu336-Tth296(AKK), AT1-1

Two overlapping PCR fragments were generated. The first fragment was made using the AfuFEN construct (SEQ ID NO:556) as template with the primers: 390-076-08 5'-tgt-gga-att-gtg-agc-gg-3' (SEQ ID NO:314) and 390-065-05 5'-gaa-cca-cct-ctc-aag-cgt-gg-3' (SEQ ID NO: 554). The second fragment was made using TthAKK (SEQ ID NO:558) as template and the primers: 700-049-01 5'-acg-ctt-gag-agg-tgg-ttc-ctg-gag-gag-gcc-ccc-tgg-3' (SEQ ID NO: 555) and 390-076-09 5'-taa-tct-gta-tca-ggc-tg-3' (SEQ ID NO:557). The two products contain a region of sequence overlap, and were combined and amplified with outside primers 390-076-08 and 390-076-09 in a recombinant PCR reaction. The recombinant PCR product was cut with the restriction enzymes BspEI and SalI and ligated into the AfuFEN construct which was prepared by cutting with the same enzymes to yield Afu336-Tth296(AKK) construct (DNA sequence SEQ ID NO: 559; amino acid sequence SEQ ID NO: 560).

Construction of Afu328-Tth296(AKK), AT2-3

Two overlapping PCR fragments were generated, the first by primers: 390-076-08 5'-tgt-gga-att-gtg-agc-gg-3' (SEQ ID NO:314) and 700-049-02 5'-ggt-tga-ctt-cag-agc-ttt-gag-3' (SEQ ID NO: 561) with template AfuFEN (DNA sequence SEQ ID NO:556), and the second by primers: 700-049-03 5'-aaa-gct-ctg-aag-tca-acc-ctg-gag-gag-gcc-ccc-tgg-3' (SEQ ID NO: 562) and 390-076-09 5'-taa-tct-gta-tca-ggc-tg-3' (SEQ ID NO:557) with template TthAKK (DNA sequence SEQ ID NO:558). The two products were combined and amplified with outside primers 390-076-08 and 390-076-09. The recombinant PCR product was cut with the restriction enzymes BspEI and SalI and ligated into the vector pAfuFEN which was prepared by cutting with the same enzymes to yield Afu336-Tth296(AKK) construct (DNA sequence SEQ ID NO: 563; amino acid sequence SEQ ID NO: 564).

Construction of Afu336-Taq5M

The Taq5M construct (SEQ ID NO:41) was cut with the enzymes NotI and SalI and the smaller insert fragment was gel isolated. The Afu336-Tth296(AKK) construct (DNA sequence SEQ ID NO: 559) was also cut with the same restriction enzymes and the larger vector fragment was purified. The insert (Taq5M polymerase domain) was then ligated into the vector to generate the Afu336-Taq5M construct (DNA sequence SEQ ID NO: 565; amino acid sequence SEQ ID NO: 566).

Construction of Afu336-TaqDN

The TaqDNHT construct was cut with the enzymes NotI and SalI and the smaller insert fragment was gel isolated. The Afu336-Tth296(AKK) construct (DNA sequence SEQ ID NO: 559) was also cut with the same restriction enzymes and the larger vector fragment was purified. The insert (TaqDN polymerase domain) was then ligated into the vector to generate the Afu336-Taq5M construct (DNA sequence SEQ ID NO: 567; amino acid sequence SEQ ID NO: 568).

Random Chimerization of *Thermus* Polymerases

Numerous enzymes with altered functions were generated via random chimerization of *Thermus* polymerases based on the principal of DNA shuffling (Volkov and Arnold, *Methods in Enzymology* 328:456 [2000]). The procedure below was used to develop the following chimeras.

The genes of interest for random chimerization were PCR amplified with primers: 390-076-08 5'-tgt-gga-att-gtg-agc-gg-3' (SEQ ID NO:314) and 209-074-02: 5'-gtg-gcc-tcc-ata-tgg-gcc-agg-ac-3' (SEQ ID NO:316) to generate the approximately 1.4 kbp templates. About 2 µg of the DNA templates were mixed in equal proportion, and then digested with DNase I (0.33 U) in a 30 µl reaction at 15° C. for approximately 1 minute to generate fragments 50–200 bp in size. DNA fragments were purified in a 4% agarose gel and extracted by QIAEXII gel extraction kit (QIAGEN) according to manufacturer's instructions. The purified fragments (10 µl) were added to 10 µl of 2×PCR pre-mix (5-fold diluted, cloned Pfu buffer, 0.4 mM each dNTP, 0.06 U/µl cloned Pfu DNA polymerase, STRATAGENE Cat.# 600153, with accompanying buffer) for the fragment reassembly reaction (PCR program: 3 min 94° C. followed by 40 cycles of 30 sec 94° C., 1 min 52° C., 2 min+5 s/cycle 72° C., followed by 4 min at 72° C.). The reassembled products (1 µl of a 10-fold dilution) were then PCR amplified with a pair of nested primers: 072-090-01 5'-gag-cgg-ata-aca-att-tca-cac-agg-3' (SEQ ID NO: 569) and 189-082-01 5'-tgc-ccg-gtg-cac-gcg-gcc-gcc-cct-gca-ggc-3' (SEQ ID NO: 570) using the CLONTECH GC melt cDNA PCR kit (Cat.# K1907-Y) according to the manufacturer's instructions. The purified PCR products were digested with restriction enzymes EcoRI and NotI and then ligated into the TthAKK construct that was prepared by cutting with the same enzymes. The ligation mixture was transformed into JM109 competent cells and colonies were screened for enzyme activity.

1. Generation of Random Chimeras S26 and S36

The templates used to develop these chimeric enzymes were the nuclease domains from TthAKK, TaqTthAKK, TscTthAKK and the TfiTthAKK constructs. Two clones were found to show improvement of activity based on primary activity screening. Random chimeras S26 (DNA sequence SEQ ID NO: 571; amino acid sequence SEQ ID NO: 572) and S36 (DNA sequence SEQ ID NO: 573; amino acid sequence SEQ ID NO: 574) were then sequenced and isolated.

2. Introduction of L107F/E108T, L109FV101T and K69E Mutations in S26 and S36 to Improve Substrate Specificity Construction of S26(FT)

Site specific mutagenesis was performed on pS26 DNA using the mutagenic primers: 785-008-03 5'-ttt-acc-cgc-ctc-gag-gtg-cg-ggc-3' (SEQ ID NO: 489) and 680-21-03 5'-cgg-cac-ctc-gag-gcg-ggt-aaa-gcc-caa-aag-gtc-cac-3' (SEQ ID NO: 490) to introduce the L107F/E108T mutations and generate S26(FT) (DNA sequence SEQ ID NO: 575; amino acid sequence SEQ ID NO: 576).

Construction of S36(FT)

Site specific mutagenesis was performed on pS36 DNA using the mutagenic primers: 785-096-01: 5'-gtg-gac-ctt-ctg-ggc-ttt-acc-cgc-ctc-gag-gcc-ccg-3' (SEQ ID NO: 486) and 785-096-02: 5'-cgg-ggc-ctc-gag-gcg-ggt-aaa-gcc-cag-aag-gtc-cac-3' (SEQ ID NO: 487) to introduce the L109F/V110T mutations and generate S36(FT) (DNA sequence SEQ ID NO: 577; amino acid sequence SEQ ID NO: 578).

Construction of S26(K69E)

Site specific mutagenesis was performed on S26 DNA using the mutagenic primers: 5'-atc-gtg-gtc-ttt-gac-gcc-gag-gcc-ccc-tcc-ttc-c-3' (SEQ ID NO: 492) and 5'-gga-agg-agg-ggg-cct-cgg-cgt-caa-aga-cca-cga-t-3' (SEQ ID NO: 493) to introduce the K69E mutation and to generate S26(K69E) (DNA sequence SEQ ID NO: 579; amino acid sequence SEQ ID NO: 580).

Construction of S26(FT/K69E)

Site specific mutagenesis was performed on S26(FT) DNAs using the mutagenic primers: 5'-atc-gtg-gtc-ttt-gac-gcc-gag-gcc-ccc-tcc-ttc-c-3' (SEQ ID NO: 492) and 5'-gga-agg-agg-ggg-cct-cgg-cgt-caa-aga-cca-cga-t-3' (SEQ ID NO: 493) to introduce the K69E mutation and to generate S26 (FT/K69E) (DNA sequence SEQ ID NO: 581; amino acid sequence SEQ ID NO: 582).

3. More Random Chimeras, N3D7, N1A12 N1C4, and N2C3

The templates used to generate these chimerics were the nuclease domains of Tth(K69E)AKK, Taq(K69E)TthAKK, Tsc(K69E)TthAKK and Tfi(K69E)TthAKK constructs. Four clones were shown to have improved activity based on the primary activity screening. Random chimeras N3D7 (DNA sequence SEQ ID NO: 583; amino acid sequence SEQ ID NO: 584), N1A12 (DNA sequence SEQ ID NO: 585; amino acid sequence SEQ ID NO: 586), N1C4 (DNA sequence SEQ ID NO: 587; amino acid sequence SEQ ID NO: 588) and N2C3 (DNA sequence SEQ ID NO: 589; amino acid sequence SEQ ID NO:590) were then sequenced and isolated respectively.

Generation of G, L and GL Variants

A variant of Tth polymerase having an Asp to Gly change at amino acid 385 (D385G) and an Arg toLeu change at amino acid 455 (R455L), (amino acid SEQ ID NO:2712; gene sequence SEQ ID NO:2713) was used to create derivatives and chimerical enzymes. Constructs comprising these two amino acid variations are indicated by the 'GL' designation, below. Chimeras comprising only one of the variations are indicated as either 'G' or 'L'. To create a non-polymerizing variant, the sequence encoding an aspartic acid at position 787 was changed by site-specific mutagenesis as described above to a sequence encoding asparagine. Mutagenesis of pTrcTth GL-2 with the following oligonucleotide: 5'-CAG-GAGGAGCTCGTTGTGGACCTGGA-3' (SEQ ID NO:260) was performed to create the plasmid pTrcTthDN GL. The mutant protein and coding nucleic acid sequence is termed TthDN GL, SEQ ID NOS:2714 and 2715 respectively.

A. Tth DN HT GL

Six amino acid histidine tags (his-tags) were added onto the carboxy termini of Tth DN GL, as described above for Tth DN. The resulting mutant gene is termed Tth DN HT GL (SEQ ID NO:2716, nucleic acid sequence; SEQ ID NO:2717, amino acid sequence). The protein was expressed and purified as described for Tth DN HT, above.

B. Generation of Tth DN RX HT GL

Mutagenesis was performed to introduce 3 additional, unique restriction sites into the polymerase domain of Tth DN HT enzymes. Site-specific mutagenesis was performed using the Transformer Site-Directed Mutagenesis Kit from (Clonetech) according to manufacturer's instructions. One of two different selection primers, Trans Oligo AlwNI/SpeI or Switch Oligo SpeI/AlwNI (Clontech, Palo Alto Calif. catalog #6488-1 or catalog #6373-1) was used for all mutagenesis reactions described. The selection oligo used in a given reaction is dependent on the selection restriction site present in the vector. All mutagenic primers were synthesized by standard synthetic chemistry. Resultant colonies were expressed in E.coli strain JM109.

The Not I site (amino acid position 328) was created using the mutagenic primers 5'-gccgccaggggcggccgcgtccaccgggcc (SEQ ID NO:269) and 5'-gcctgcaggggcggccgcgtgcac-cggggca (SEQ ID NO:270) corresponding to the sense strand of the Tth DN HT GL gene. The BstI (amino acid position 382) and NdeI (amino acid position 443) sites were introduced into the gene using sense strand mutagenic primes 5'-ctcctggacccttcgaacaccacccc (SEQ ID NO:271) and 5'-gtcctggcccatatggaggccac (SEQ ID NO:272). The mutant plasmid was over-expressed and purified using Qiagen QiaPrep Spin Mini Prep Kit (cat. # 27106). The vector were tested for the presence of the restriction sites by DNA sequencing and restriction mapping. This construct is termed Tth DN RX HT GL (DNA sequence SEQ ID NO:2718; amino acid SEQ ID NO:2719). Chimeric constructs were created using Tth DN RX HT GL.

1. Construction of TaqTth(N) GL

The first exchange that was performed involved the polymerase domains of the two enzymes. Separation of the nuclease domain (the N-terminal end of the protein) from the polymerase domain (the C-terminal portion of the protein) was accomplished by cutting both genes with the restriction endonucleases EcoRI and NotI. The approximately 900 base pair fragment from the Taq DN RX HT gene was cloned into the homologous sites of the Tth DN RX HT GL gene, yielding the chimera TaqTth(N) GL (DNA sequence SEQ ID NO:2675; amino acid sequence SEQ ID NO:2641) which has the Taq DN RX HT 5' nuclease domain and the Tth DN RX HT GL polymerase domain.

2. Construction of TaqTth(N-B) GL

The Taq DN RX HT construct was cut with the enzymes NdeI and BamHI and the larger, vector fragment was gel isolated as detailed above. The Tth DN RX HT GL construct was also cut with NdeI and BamHI and the smaller (approximately 795 base pairs) Tth fragment was gel isolated and purified. The Tth GL NdeI-BamHI insert was ligated into the Taq NdeI-BamHI vector as detailed above to generate the TaqTth(N-B) GL (DNA sequence SEQ ID NO:2676; amino acid sequence SEQ ID NO:2642).

3. Construction of TaqTth(N-D) G

The Taq DN RX HT construct was cut with the enzymes NotI and NdeI and the larger vector fragment was isolated as detailed above. The Tth DN RX HT GL construct was also cut with NotI and NdeI and the smaller (approximately 345 base pairs) Tth fragment was gel isolated and purified. The Tth GL NotI-NdeI insert was ligated into the Taq NotI-NdeI vector as detailed above to generate the TaqTth (N-D) G (DNA sequence SEQ ID NO:2677; amino acid sequence SEQ ID NO:2643).

4. Construction of TaqTth(D-B) L

The Taq DN RX HT construct was cut with the enzymes NdeI and BamHI and the larger vector fragment was isolated as detailed above. The Tth DN RX HT GL construct was also cut with NdeI and BamHI and the smaller (approximately 450 base pairs) Tth fragment was gel isolated and purified. The Tth GL NdeI-BamHI insert was ligated into the Taq NdeI-BamHI vector as detailed above to generate the TaqTth(D-B) L (DNA sequence SEQ ID NO:2678; amino acid sequence SEQ ID NO:2644).

5. Construction of TaqTth(Bs-B) L

The Taq DN RX HT construct was cut with the enzymes BstBI and BamHI and the larger vector fragment was isolated as detailed above. The Tth DN RX HT GL construct was also cut with BstBI and BamHI and the smaller (approximately 633 base pairs) Tth fragment was gel isolated and purified. The Tth GL NdeI-BamHI insert was ligated into the Taq NdeI-BamHI vector as detailed above to generate TaqTth(Bs-B) L (DNA sequence SEQ ID NO:2679; amino acid sequence SEQ ID NO:2645).

6. Construction of TaqTth(N-Bs) G

The Taq DN RX HT construct was cut with the enzymes NotI and BstBI and the larger vector fragment was isolated as detailed above. The Tth DN RX HT GL construct was also cut with NotI and BstBI and the smaller (approximately 162 base pairs) Tth fragment was gel isolated and purified. The Tth GL NotI-BstBI insert was ligated into the Taq NotI-BstBI vector as detailed above to generate TaqTth(N-Bs) G (DNA sequence SEQ ID NO:2680; amino acid sequence SEQ ID NO:2646).

7. Construction of TthTaq(B-S) GL

The Tth DN RX HT GL construct was cut with the enzymes BamHI and SalI and the larger vector fragment was isolated as detailed above. The Taq DN RX HT construct was also cut with BamHI and SalI and the smaller (approximately 741 base pairs) Taq fragment was gel isolated and purified. The Taq BamHI-SalI insert was ligated into the Tth GL BamHI-SalI vector as detailed above to generate the TthTaq(B-S) GL (DNA sequence SEQ ID NO:2681; amino acid sequence SEQ ID NO:2647).

8. Construction of TaqTth(D-B) L E404H (DNA Sequence SEQ ID NO:2684; Amino Acid Sequence SEQ ID NO:2650)

Site specific mutagenesis was performed on pTrc99A TaqTth(D-B) L DNA using the mutagenic primer 240-60-01 5'-gag gag gcg ggg cac cgg gcc gcc ctt-3' (SEQ ID NO:277) to introduce the E404H mutation.

9. Construction of TaqTth(D-B) L F413H/A414R (DNA Sequence SEQ ID NO:2685; Amino Acid Sequence SEQ ID NO:2651)

Site specific mutagenesis was performed on pTrc99A TaqTth(D-B) L DNA using the mutagenic primer 240-60-02 5'-ctt tcc gag agg ctc cat cgg aac ctg tgg ggg agg-3' (SEQ ID NO:278) to introduce the F413H and the A414R mutations.

10. Construction of TaqTth(D-B) L W417L/G418K (DNA Sequence SEQ ID NO:2686; Amino Acid Sequence SEQ ID NO:2652)

Site specific mutagenesis was performed on pTrc99A TaqTth(D-B) L DNA using the mutagenic primer 240-60-03 5'-ctc ttc gcc aac ctg ctt aag agg ctt gag ggg gag-3' (SEQ ID NO:279) to introduce the W417L and the G418K mutations.

11. Construction of TaqTth(D-B) L A439R (DNA Sequence SEQ ID NO:2687; Amino Acid Sequence SEQ ID NO:2653)

Site specific mutagenesis was performed on pTrc99A TaqTth(D-B) DNA using the mutagenic primer 240-60-04 5'-agg ccc ctt tcc cgg gtc ctg gcc cat-3' (SEQ ID NO:280) to introduce the A439R mutation.

12. Construction of TaqTth(N-D) G L451R (DNA Sequence SEQ ID NO:2688; Amino Acid Sequence SEQ ID NO:2654)

Site specific mutagenesis was performed on pTrc99A TaqTth(N-D) G DNA using the mutagenic primer 240-60-05 5'-acg ggg gtg cgc cgg gac gtg gcc tat-3' (SEQ ID NO:281) to introduce the L415 mutation.

13. Construction of TaqTth(N-D) G R457Q (DNA Sequence SEQ ID NO:2689; Amino Acid Sequence SEQ ID NO:2655)

Site specific mutagenesis was performed on pTrc99A TaqTth(N-D) G DNA using the mutagenic primer 240-60-06 5'-gtg gcc tat ctc cag gcc ttg tcc ctg-3' (SEQ ID NO:282) to introduce the L415Q mutation.

14. Construction of TaqTth(N-D) G V463L (DNA Sequence SEQ ID NO:2690; Amino Acid Sequence SEQ ID NO:2656)

Site specific mutagenesis was performed on pTrc99A TaqTth(N-D) G DNA using the mutagenic primer 240-60-07 5'-ttg tcc ctg gag ctt gcc gag gag atc-3' (SEQ ID NO:283) to introduce the V463L mutation.

15. Construction of TaqTth(N-D) G A468R (DNA Sequence SEQ ID NO:2691; Amino Acid Sequence SEQ ID NO:2657)

Site specific mutagenesis was performed on pTrc99A TaqTth(N-D) G DNA using the mutagenic primer 240-60-08 5'-gcc gag gag atc cgc cgc ctc gag gcc-3' (SEQ ID NO:284) to introduce the A468R mutation.

16. Construction of TaqTth(N-D) G A472E (DNA Sequence SEQ ID NO:2692; Amino Acid Sequence SEQ ID NO:2658)

Site specific mutagenesis was performed on pTrc99A TaqTth(N-D) G DNA using the mutagenic primer 240-60-09 5'-gcc cgc ctc gag gag gag gte tte cgc-3' (SEQ ID NO:285) to introduce the A472E mutation.

17. Construction of TaqTth(N-D) G G499R (DNA Sequence SEQ ID NO:2693; Amino Acid Sequence SEQ ID NO:2659)

Site specific mutagenesis was performed on pTrc99A TaqTth(N-D) G DNA using the mutagenic primer 240-60-10 5'-ttt gac gag cta agg ctt ccc gcc atc-3' (SEQ ID NO:286) to introduce the G499R mutation.

18. Construction of TaqTth(N-D) G E507Q (DNA Sequence SEQ ID NO:2694; Amino Acid Sequence SEQ ID NO:2660)

Site specific mutagenesis was performed on pTrc99A TaqTth(N-D) G DNA using the mutagenic primer 276-046-04 5'-atc gcc aag acg caa aag acc ggc aag-3' (SEQ ID NO:287) to introduce the E507Q mutation.

19. Construction of TaqTth(N-D) G Y535H (DNA Sequence SEQ ID NO:2695; Amino Acid Sequence SEQ ID NO:2661)

Site specific mutagenesis was performed on pTrc99A TaqTth(N-D) G DNA using the mutagenic primer 240-60-11 5'-aag atc ctg cag cac cgg gag ctc acc-3' (SEQ ID NO:288) to introduce the Y535H mutation.

20. Construction of TaqTth(N-D) G S543N (DNA Sequence SEQ ID NO:2696; Amino Acid Sequence SEQ ID NO:2662)

Site specific mutagenesis was performed on pTrc99A TaqTth(N-D) G DNA using the mutagenic primer 240-60-12 5'-acc aag ctg aag aac acc tac att gac-3' (SEQ ID NO:289) to introduce the S543N mutation.

21. Construction of TaqTth(N-D) G I546V (DNA Sequence SEQ ID NO:2697; Amino Acid Sequence SEQ ID NO:2663)

Site specific mutagenesis was performed on pTrc99A TaqTth(N-D) G DNA using the mutagenic primer 240-60-13 5'-aag agc acc tac gtg gac ccc ttg ccg-3' (SEQ ID NO:290) to introduce the I546V mutation.

22. Construction of TaqTth(N-D) G D551S/I553V (DNA Sequence SEQ ID NO:2698; Amino Acid Sequence SEQ ID NO:2664)

Site specific mutagenesis was performed on pTrc99A TaqTth(N-D) G DNA using the mutagenic primer 240-60-14 5'-att gac ccc ttg ccg agc ctc gtc cac ccc agg acg ggc-3' (SEQ ID NO:291) to introduce the D551S and the I553V mutations.

23. Construction of Tth DN RX HT GL H641A, Tth DN RX HT GL H748A, Tth DN RX HT GL H786A Site specific mutagenesis was performed on pTrc99A Tth DN RX HT GL DNA using the mutagenic primer 583-001-02: 5'-gct tgc ggt ctg ggt ggc gat gtc ctt ccc ctc-3' (SEQ ID NO:294) to introduce the H641A mutation (DNA sequence SEQ ID NO:2699; amino acid sequence SEQ ID NO:2665), or the mutagenic primer 583-001-03: 5' cat gtt gaa ggc cat ggc ctc cgc ggc ctc cct-3' (SEQ ID NO:295) to generate the H748A mutant (DNA sequence SEQ ID NO:2700; amino acid sequence SEQ ID NO:2666), or the mutagenic primer 583-001-04: 5'-cag gag gag ctc gtt ggc gac ctg gag gag-3' (SEQ ID NO:296) to generate the H786A mutant enzyme (DNA sequence SEQ ID NO:2701; amino acid sequence SEQ ID NO:2667).

24. Construction of Tth DN RX HT GL (H786A/G506K/Q509K)

Starting with the mutant Tth DN RX HT GL H786A, generated above, site specific mutagenesis was done using the mutagenic primer 604-022-02: 5'-gga gcg ctt gcc tgt ctt ctt cgt ctt ctt caa ggc ggg agg cct-3' (SEQ ID NO:297) to generate this variant termed "TthAKK GL", (DNA sequence SEQ ID NO:2702; amino acid sequence SEQ ID NO:2668).

25. TthDN RX HT H786A Random Mutagenesis

To generate mutants in the helix-hairpin-helix region of the TthDN RX HT H786A GL (SEQ ID NO:2667) enzyme, two different PCR reactions were performed using the H786A (SEQ ID NO:2701) mutant as a template. Starting with TthDN GL H786A discussed above, and using primer 604-08-06: 5'-gtc gga ggg gtc ccc cac gag-3' (SEQ ID NO:313) and primer 390-76-08: 5'-tgt gga att gtg agc gg (SEQ ID NO:314), a 620 base pair PCR fragment was generated. PCR reactions were performed using the Advantage cDNA PCR kit (Clontech) according to manufacturer's instructions. This PCR product includes amino acids 1–194. No mutations were introduced via this reaction, however the restriction enzyme site EcoRI is present at the 5' end.

Starting with TthDN RX HT GL H786A discussed above, and using mutagenic primer 604-08-05: 5'-ctc gtg ggg gac ccc tcc gac aac ctc (ccc ggg gtc aag ggc atc ggg gag aag acc gcc) ctc aag ctt ctc aag-3' (SEQ ID NO:315) and primer 209-74-02: 5'-gtg gcc tcc ata tgg gcc agg α-3' (SEQ ID NO:316) a 787 base pair PCR fragment was generated. PCR reactions was done as above. This fragment does contain random mutations, due to the presence of the mutagenic primer, 604-08-05. The bases within the parenthesis of this primer were synthesized such that 91% of the sequence is wild-type, while the additional 9% is evenly divided between the remaining 3 bases.

The two PCR fragments overlap, and were combined in a recombinant PCR reaction. Primers 390-76-08 and 209-74-02 were added, and the Advantage cDNA PCR kit (Clontech) was again used according to manufacturer's instructions. A 1380 base pair product was generated from this reaction.

The recombinant PCR product was cut with the restriction enzymes EcoRI and NotI according to the manufacturer's instructions to yield a 986 base pair fragment. TthDN RX HT GL H786A was prepared by cutting with the same enzymes. The fragment was then ligated into the vector, and transformed into JM109 cells. New mutants developed from this set of reactions include:

TthDN RX HT GL H786A/P197R/K200R (DNA sequence SEQ ID NO:2703; amino acid sequence SEQ ID NO:2669).

TthDN RX HT GL H786A/K205Y (DNA sequence SEQ ID NO:2704; amino acid sequence SEQ ID NO:2670).

TthDN RX HT GL H786A/G203R (DNA sequence SEQ ID NO:2705; amino acid sequence SEQ ID NO:2671).

26. Construction of TaqTthAKK GL (DNA Sequence SEQ ID NO:2706; Amino Acid Sequence SEQ ID NO:2672)

Chimeric mutant TaqTthAKK GL was generated by cutting Tth DN RX HT GL (H786A/G506K/Q509K) (SEQ ID NO:2702; here abbreviated TthAKK GL) and Taq 4M G504 (SEQ ID NO:108; here abbreviated Taq 5M) with the restriction endonucleases EcoRI and NotI. The smaller insert fragment of Taq 5M and the larger vector fragment of Tth AKK GL were gel purified as detailed in Example 3D, and the insert fragments were ligated as described in Example 3D. Screening and verification of the construct sequence was also done as in Example 3D.

27. Construction of TfiTth AKK GL (DNA Sequence SEQ ID NO:2707; Amino Acid Sequence SEQ ID NO:2673), TscTthAKK GL (DNA Sequence SEQ ID NO:2708; Amino Acid Sequence SEQ ID NO:2674)

To generate chimeric enzymes between TthAKK GL (SEQ ID NO:2702), and Tfi DN 2M (SEQ ID NO:130), or Tsc DN 2M (SEQ ID NO:131), Tth DN RX HT GL (H786A/G506K/Q509K) DNA (SEQ ID NO:2702) was cut with EcoRI and NotI, and the larger vector fragment was gel isolated as above. The 993 base pair Eco RI-NotI fragements of Tfi and Tsc were prepared as described in Example 8. Ligations were performed as detailed in Example 3D, as was the screening and verification of the new constructs.

28. Construction of TthAKK GL (P195A) and TthAKK GL (P195K)

To introduce mutations at amino acid position 195 (either a P195A or P195K) in the nuclease domain of TthAKK GLconstruct, mutagenic primer 785-073-01 (P195A) 5'-ccc-tcc-gac-aac-ctc-gcc-ggg-gtc-aag-ggc-atc-3' (SEQ ID NO: 370) or 785-073-02 (P195K) 5'-ccc-tcc-gac-aac-tc-aag-ggg-gtc-aag-ggc-atc-3' (SEQ ID NO: 371) and primer 209-074-02: 5'-gtg-gcc-tcc-ata-tgg-gcc-agg-ac-3' (SEQ ID NO:316) were used in a PCR reaction to generate a 787 base pair fragment. Another PCR fragment was obtained by using the primers: 390-076-08 5'-tgt-gga-att-gtg-agc-gg-3' (SEQ ID NO:314) and 785-073-03 5'-gag-gtt-gtc-gga-ggg-gtc-3' (SEQ ID NO: 372) in a reaction with the same template.

The two PCR fragments overlap and were combined in a recombinant PCR reaction. The outside primers 390-076-08 and 209-074-02 were added, and the Advantage cDNA PCR kit (Clontech) was used according to manufacturer's instructions. A 1380 base pair product was generated from this reaction.

The recombinant PCR product was cut with the restriction enzymes EcoRI and NotI to yield a 986 base pair fragment. The TthAKK GLconstruct was prepared by cutting with the same enzymes. The fragment was then ligated into the vector, and transformed into JM109 cells. New mutants developed from this set of reactions include: TthAKK GL(P195A) (DNA sequence SEQ ID NO: 2721; amino acid sequence SEQ ID NO: 2722) and TthAKK GL (P195K) (DNA sequence SEQ ID NO: 723; amino acid sequence SEQ ID NO:2724).

29. Construction of TthAKK GL (N417K/L418K)

The same approach was used to construct TtbAKK GL (N417K/L418K). Two overlapping PCR fragments were generated by mutagenic primers: 785-73-07 5'-gag-agg-ctc-cat-cgg-aag-aag-ctt-aag-cgc-ctc-gag-3' (SEQ ID NO: 377) and 700-10-03 5'-ctt-ctc-tca-tcc-gcc-aaa-aca-gcc-3' (SEQ ID NO:343), and primers 158-084-01 5'-ctc-ctc-cac-gag-ttc-ggc-3' (SEQ ID NO:310) and 785-73-08 5'-ccg-atg-gag-cct-ctc-cga-3' (SEQ ID NO: 378). The two products were combined and amplified with outside primers 700-10-03 and 158-084-01. The recombinant PCR product was cut with the restriction enzymes NotI and BamHI and ligated into the NotI/BamHI pre-cut TthAKK GL construct. This mutant was termed TthAKK GL (N417K/L418K) (DNA sequence SEQ ID NO: 2725; amino acid sequence SEQ ID NO: 2726).

30. Construction of TthAKK GL (P255L)

Site specific mutagenesis was performed on the TthAKK GL construct using the mutagenic primer 886-049-05 and 886-049-06: 5'-gtg-cgc-acc-gac-ctc-ctc-ctg-gag-gtg-gac-ctc-3' (SEQ ID NO: 381), 5'-gag-gtc-cac-ctc-cag-gag-gag-gtc-ggt-gcg-cac-3' (SEQ ID NO: 382) to generate TthAKK GL (P255L) (DNA sequence SEQ ID NO: 2727; amino acid sequence SEQ ID NO: 2728).

31. Construction of TthAKK GL (F311Y)

Site specific mutagenesis was performed on the TthAKK GL construct using the mutagenic primer 886-049-09 and 886-049-10: 5'-ggg-gcc-ttc-gtg-ggc-tac-gtc-ctc-tcc-cgc-ccc-3' (SEQ ID NO: P385), 5'-ggg-gcg-gga-gag-gac-gta-gcc-cac-gaa-ggc-ccc-3' (SEQ ID NO: 386) to generate TthAKK GL (F311Y) (DNA sequence SEQ ID NO:2729; amino acid sequence SEQ ID NO:2730).

32. Construction of TthAKK GL (N221H/R224Q)

Site specific mutagenesis was performed on the TthAKK GL construct using the mutagenic primer 886-049-01 and 886-049-02: 5'-gaa-aac-ctc-ctc-aag-cac-ctg-gac-cag-gta-aag-cca-gaa-aac-3' (SEQ ID NO: 389), 5'-gtt-ttc-tgg-ctt-tac-ctg-gtc-cag-gtg-ctt-gag-gag-gtt-ttc-3' (SEQ ID NO: 390) to generate TthAKK GL (N221H/R224Q) (DNA sequence SEQ ID NO: 2731; amino acid sequence SEQ ID NO: 2732).

33. Construction of TthAKK GL (R251H)

Site specific mutagenesis was performed on TthAKK GL construct using the mutagenic primer 886-049-03 and 886-049-04: 5'-gag-ctc-tcc-cgg-gtg-cac-acc-gac-ctc-ccc-ctg-3' (SEQ ID NO: 393), 5'-cag-ggg-gag-gtc-ggt-gtg-cac-ccg-gga-gag-ctc-3' (SEQ ID NO: 394) to generate TthAKK GL (R251H) (DNA sequence SEQ ID NO:2733; amino acid sequence SEQ ID NO:2734).

34. Construction of TthAKK GL (P255L/R251H)

Site specific mutagenesis was performed on the TthAKK GL (P255L) construct using the mutagenic primer 886-088-01 and 886-088-02: 5'-gag-ctc-tcc-cgg-gtg-cac-acc-gac-ctc-ctc-ctg-3' (SEQ ID NO: 397), 5'-cag-gag-gag-gtc-ggt-gtg-cac-ccg-gga-gag-ctc-3' (SEQ ID NO: 398) to generate TthAKK GL (P255L/R251H) (DNA sequence SEQ ID NO:2735; amino acid sequence SEQ ID NO:2736).

35. Construction of Tth AKK GL L429V (DNA Sequence SEQ ID NO:2737; Amino Acid Sequence SEQ ID NO:2738)

Palm region randomization mutagenesis was performed on the Tth AKK GL construct using the mutagenic primer 680-79-02 5'-ctc cat cgg aac ctc ctt [aag cgc ctc gag ggg gag gag aag ctc ctt tgg] ctc tac cac gag gtg-3' (SEQ ID NO: 403) and reverse primer 680-79-04 5'-AAG GAG GTT CCG ATG GAG-3' (SEQ ID NO: 404) to introduce the random mutations in the Palm region. Brackets indicate a synthesis of 91% base shown and 3% all other bases.

36. Construction of Tth AKK GL E425V (DNA Sequence SEQ ID NO:2739; Amino Acid Sequence SEQ ID NO:2740)

Palm region randomization mutagenesis was performed on the Tth AKK GL construct using the mutagenic primer 680-79-02 5'-ctc cat cgg aac ctc ctt [aag cgc ctc gag ggg gag gag aag ctc ctt tgg] ctc tac cac gag gtg-3' (SEQ ID NO: 403) and reverse primer 680-79-04 5'-AAG GAG GTT CCG ATG GAG-3' (SEQ ID NO: 404) to introduce the random mutations in the Palm region. Brackets indicate a synthesis of 91% base shown and 3% all other bases.

37. Construction of Tth AKK GL L422N/E425K (DNA Sequence SEQ ID NO:2741; Amino Acid Sequence SEQ ID NO:2742)

Palm region randomization mutagenesis was performed on the Tth AKK GL construct using the mutagenic primer 680-79-02 5'-ctc cat cgg aac ctc ctt [aag cgc ctc gag ggg gag gag aag ctc ctt tgg] ctc tac cac gag gtg-3' (SEQ ID NO: 403) and reverse primer 680-79-04 5'-AAG GAG GTT CCG ATG GAG-3' (SEQ ID NO: 404) to introduce the random mutations in the Palm region. Brackets indicate a synthesis of 91% base shown and 3% all other bases.

38. Construction of Tth AKK GL L422F/W430C (DNA Sequence SEQ ID NO:2743; Amino Acid Sequence SEQ ID NO:2744)

Palm region randomization mutagenesis was performed on Tth AKK GL DNA using the mutagenic primer 680-79-02 5'-ctc cat cgg aac ctc ctt [aag cgc ctc gag ggg gag gag aag ctc ctt tgg] etc tac cac gag gtg-3' (SEQ ID NO: 403) and reverse primer 680-79-04 5'-AAG GAG GTT CCG ATG GAG-3' (SEQ ID NO: 404) to introduce the random mutations in the Palm region. Brackets indicate a synthesis of 91% base shown and 3% all other bases.

39. Construction of Tth AKK GL A504F (DNA Sequence SEQ ID NO:2745; Amino Acid Sequence SEQ ID NO:2746)

Site saturation mutagenesis was performed on Tth AKK GL construct using the mutagenic primer 680-80-03 5'-cag gag ctt agg ctt ccc nnn ttg aag aag acg aag aag aca-3' (SEQ ID NO: 413) and reverse primer 680-80-06 5'-cct aag ctc gtc aaa gag-3' (SEQ ID NO: 414) to introduce the random mutations in the A504 amino acid.

40. Construction of Tth AKK GL A504V (DNA Sequence SEQ ID NO:2747; Amino Acid Sequence SEQ ID NO:2748)

Site saturation mutagenesis was performed on Tth AKK GL construct using the mutagenic primer 680-80-03 5'-cag gag ctt agg ctt ccc nnn ttg aag aag acg aag aag aca-3' (SEQ ID NO: 413) and reverse primer 680-80-06 5'-cct aag ctc gtc aaa gag-3' (SEQ ID NO: 414) to introduce the random mutations in the A504 amino acid.

41. Construction of Tth AKK GL A504S (DNA Sequence SEQ ID NO:2749; Amino Acid Sequence SEQ ID NO: 2750)

Site saturation mutagenesis was performed on Tth AKK GL construct using the mutagenic primer 680-80-03 5'-cag gag ctt agg ctt cc nnn ttg aag aag acg aag aag aca-3' (SEQ ID NO: 413) and reverse primer 680-80-06 5'-cct aag ctc gtc aaa gag-3' (SEQ ID NO: 414) to introduce the random mutations in the A504 amino acid.

42. Construction of Tth AKK GL S517G (DNA Sequence SEQ ID NO:2751; Amino Acid Sequence SEQ ID NO: 2752)

Site saturation mutagenesis was performed on Tth AKK GL construct using the mutagenic primer 680-80-07 5'-GGC AAG CGC TCC ACC NNN GCC GCG GTG CTG GAG GCC CTA CGG-3' (SEQ ID NO: 421) and reverse primer 680-80-10 5'-GGT GGA GCG CTT GCC-3' (SEQ ID NO: 422) to introduce the random mutations in the S517 amino acid.

43 Construction of Tth AKK GL A518L (DNA Sequence SEQ ID NO:2753; Amino Acid Sequence SEQ ID NO:2754)

Site saturation mutagenesis was performed on Tth AKK GL construct using the mutagenic primer 680-80-07 5'-GGC AAG CGC TCC ACC AGC NNN GCG GTG CTG GAG GCC CTA CGG-3' (SEQ ID NO: 425) and reverse primer 680-80-10 5'-GGT GGA GCG CTT GCC-3' (SEQ ID NO:422) to introduce the random mutations in the A518 amino acid.

44. Construction of Tth AKK GL A518R (DNA Sequence SEQ ID NO:2755; Amino Acid Sequence SEQ ID NO:2756)

Site saturation mutagenesis was performed on Tth AKK GL construct using the mutagenic primer 680-80-07 5'-GGC AAG CGC TCC ACC AGC NNN GCG GTG CTG GAG GCC CTA CGG-3' (SEQ ID NO: 425) and reverse primer 680-80-10 5'-ggt gga gcg ctt gcc-3' (SEQ ID NO: 422) to introduce the random mutations in the A518 amino acid.

45. Construction of Tth AKK GL A504K (DNA Sequence SEQ ID NO:2757; Amino Acid Sequence SEQ ID NO:2758)

Site directed mutagenesis was performed on the Tth AKK GL construct using the mutagenic primer 680-69-04 5'-ctt agg ctt ccc aag ttg aag aag acg aag aag aca-3' (SEQ ID NO: 433) and reverse primer 680-69-05 5'-tgt ctt ctt cgt ctt ctt caa ctt ggg aag cct aag-3' (SEQ ID NO: 434) to introduce the A504K mutation in the Tth AKK GL enzyme.

46. Construction of Tth AKK GL H641A (DNA Sequence SEQ ID NO:2759; Amino Acid Sequence SEQ ID NO:2760)

Site directed mutagenesis was performed on Tth AKK GL construct using the mutagenic primer 680-69-08 5'-gag ggg aag gac atc gcc acc cag acc gca agc-3' (SEQ ID NO: 437) and reverse primer 583-01-02 5'-gct tgc ggt ctg ggt ggc gat gtc ctt ccc ctc-3' (SEQ ID NO: 438) to introduce the H641A mutation in the Tth AKK GL enzyme.

47. Construction of Tth AKK GL T508P (DNA Sequence SEQ ID NO:2761; Amino Acid Sequence SEQ ID NO:2762)

Site directed mutagenesis was performed on TthAKK GL construct using the mutagenic primer 680-70-01 5'-ccc-gcc ttg aag aag ccg aag aag aca ggc aag-3' (SEQ ID NO: 441) and reverse primer 680-70-02 5'-ctt gcc tgt ctt ctt cgg ctt ctt caa ggc ggg-3' (SEQ ID NO: 442) to introduce the T508P mutation in the Tth AKK GL enzyme.

48. Construction of Taq(FT)TthAKK GL

Site specific mutagenesis was performed on the TaqT-thAKK GL construct using the mutagenic primer 473-087-05: 5'-cgg-gac-ctc-gag-gcg-cgt-gaa-ccc-cag-gag-gtc-cac-3' (SEQ ID NO: 483) to introduce the L107F/A108T mutations and generate Taq(FT)TthAKK GL (DNA sequence SEQ ID NO:2779; amino acid sequence SEQ ID NO:2780).

49. Construction of Tfi(FT)TthAKK GL

Site specific mutagenesis was performed on the TfiT-thAKK GL construct using the mutagenic primers 785-096-01: 5'-gtg-gac-ctt-ctg-ggc-ttt-acc-cgc-ctc-gag-gcc-ccg-3' (SEQ ID NO: 486) and 785-096-02: 5'-cgg-ggc-ctc-gag-gcg-ggt-aaa-gcc-cag-aag-gtc-cac-3' (SEQ ID NO: 487) to introduce the L107F/V108T mutations and generate Tfi(FT)TthAKK GL (DNA sequence SEQ ID NO:2720; amino acid sequence SEQ ID NO:2781).

50. Construction of Tsc(FT)TthAKK GL

Site specific mutagenesis was performed on the TscT-thAKK GL construct using the mutagenic primers 785-008-03 5'-ttt-acc-cgc-ctc-gag-gtg-ccg-ggc-3' (SEQ ID NO: 489) and reverse primer 680-21-03 5'-cgg cac ctc gag gcg ggt aaa gcc caa aag gtc cac-3' (SEQ ID NO: 490) to introduce the L107F/E108T mutations and generate Tsc(FT)TthAKK GL (DNA sequence SEQ ID NO:2764; amino acid sequence SEQ ID NO:2782).

51. Fusion Between TthAKK GL Enzyme and Alpha-Peptide

A TthAKK GL-lacZ-alpha-peptide chimeric fusion was constructed to allow detection of mutations (including frame-shifts, deletions, insertions, etc.) which cause the inability of expression of the full-length fusion protein based on the colony blue-white screening (Wu et al., Nucleic Acids Research, 24:1710 [1996]).

Site specific mutagenesis was performed on TthAKK GL DNA using the mutagenic primers 959-041-03, 5'-cac-cac-cac-cac-cac-cac-gtc-gac-tag-tgc-tag-cgt-cga-cta-gct-gca-ggc-atg-caa-gct-tgg-c-3' (SEQ ID NO: 477) and 959-041-04, 5'-gcc-aag-ctt-gca-tgc-ctg-cag-cta-gtc-gac-gct-agc-act-agt-cga-cgt-ggt-ggt-ggt-ggt-ggt-g-3' (SEQ ID NO: 478) to generate pTthAKK GL-L with SalI site following the 6×His tag at the C-terminus of TthAKK GL for the insertion of lacZ alpha peptide. The alpha peptide (of 201 amino acids) was first PCR amplified from the pCRII-TOPO vector (Invitrogen) with primers 959-041-01, 5'-cag-gaa-gcg-gcc-gcg-tcg-aca-tga-cca-tga-tta-cgc-caa-gc-3' (SEQ ID NO: 479) and 959-093-01, 5'-ggg-ccc-gcc-agg-gtc-gac-tca-ggg-cga-tgg-ccc-act-acg-tga-3' (SEQ ID NO: 480). The PCR product was then digested with restriction enzyme SalI and ligated into the pTthAKK GL-L vector, which was also cut with the same enzyme to generate the chimeric construct TthAKK GL-alpha peptide (DNA sequence SEQ ID NO:2777; amino acid sequence SEQ ID NO:2778). The orientation of the insert was confirmed by sequencing.

52. Construction of TaqEFT-Tth(AKK) GL (DNA Sequence SEQ ID NO:2790; Amino Acid Sequence SEQ ID NO:2791)

Site specific mutagenesis was performed on Taq(FT)-Tth (AKK) GL DNA (SEQ ID NO: 2779) using the mutagenic primers 436-013-08: 5'-atc-gtg-gtc-ttt-gac-gcc-gag-gcc-ccc-tcc-ttc-c-3' (SEQ ID NO:503) and 436-013-09 5'-gga-agg-agg-ggg-cct-cgg-cgt-caa-aga-cca-cga-t-3' (SEQ ID NO:504) to introduce the K70E mutation.

53. Construction of TaqEFT-Tth(AKK) GL-A/M1 (DNA Sequence SEQ ID NO:2792; Amino Acid Sequence SEQ ID NO:2793)

Site specific mutagenesis was performed on Taq(EFT)-Tth(AKK) GL DNA (SEQ ID NO:2790) using the mutagenic primers 1044-038-01: 5'-cag-acc-atg-aat-tcg-gag-gcg-atg-ctg-ccc-ctc-ttt-3' (SEQ ID NO:507) and 1044-038-02: (SEQ ID NO: 508) 5'-aaa-gag-ggg-cag-cat-cgc-ctc-cga-att-cat-ggt-ctg-3' to introduce the G4EA mutation.

54. Construction of TaqEFT-Tth(AKK) GL-B/M2 (DNA Sequence SEQ ID NO:2794; Amino Acid Sequence SEQ ID NO: 2795)

Site specific mutagenesis was performed on Taq(EFT)-Tth(AKK) GL DNA (SEQ ID NO: 2790) using the mutagenic primers 1044-038-03: 5'-gcc-tac-cgc-acc-ttc-ttt-gcc-ctg-aag-ggc-ctc-3 and 1044-038-04: 5'-gag-gcc-ctt-cag-ggc-aaa-gaa-ggt-gcg-gta-ggc-3' (SEQ ID NO: 511 and 512, respectively) to introduce the H29F mutation.

55. Construction of TaqEFT-Tth(AKK) GL-C/M3 (DNA Sequence SEQ ID NO:2796; Amino Acid Sequence SEQ ID NO:2797)

Site specific mutagenesis was performed on Taq(EFT)-Tth(AKK) GL DNA (SEQ ID NO: 2790) using the mutagenic primers 1044-038-05: 5'-ctc-ctc-aag-gcc-ctc-aga-gag-gac-ggg-gac-gcg-3' and 1044-038-06: 5'-cgc-gtc-ccc-gtc-ctc-tct-gag-ggc-ctt-gag-gag-3' (SEQ ID NO: 515 and 516, respectively) to introduce the K57R mutation.

56. Construction of TaqEFT-Tth(AKK) GL-DIM5 (DNA Sequence SEQ ID NO:2798; Amino Acid Sequence SEQ ID NO:2799)

Site specific mutagenesis was performed on Taq(EFT)-Tth(AKK) GL DNA (SEQ ID NO: 2790) using the mutagenic primers 1044-038-09: 5'-gac-gac-gtc-ctg-gcc-acc-ctg-gcc-aag-aag-gcg-3' and 1044-038-10: 5'-cgc-ctt-ctt-ggc-cag-ggt-ggc-cag-gac-gtc-gtc-3' (SEQ ID NO: 519 and 520, respectively) to introduce the S125T mutation.

57. Construction of TaqEFT-Tth(AKK) GL-E/M6 (DNA Sequence SEQ ID NO:2800; Amino Acid Sequence SEQ ID NO:2801)

Site specific mutagenesis was performed on Taq(EFT)-Tth(AKK) GL DNA (SEQ ID NO: 2790) using the mutagenic primers 1044-038-11: 5'-ggg-gag-aag-acg-gcg-ctc-aag-ctt-ctg-gag-gag-3' and 1044-038-12: 5'-ctc-ctc-cag-aag-ctt-gag-cgc-cgt-ctt-ctc-ccc-3' (SEQ ID NO: 523 and 524, respectively) to introduce the R206L mutation.

58. Construction of TaqEFT-Tth(AKK) GL-F/M7 (DNA Sequence SEQ ID NO:2802; Amino Acid Sequence SEQ ID NO:2803)

Site specific mutagenesis was performed on Taq(EFT)-Tth(AKK) GL DNA (SEQ ID NO:2790) using the mutagenic primers 1044-038-13: 5'-gag-ccc-gac-cgg-gag-ggg-ctt-aag-gcc-ttt-ctg-gag-agg-3' and 1044-038-14: 5'-cct-ctc-cag-aaa-ggc-ctt-aag-ccc-ctc-ccg-gtc-ggg-ctc-3 (SEQ ID NO: 527 and 528, respectively) to introduce the R269G and R271K mutations.

59. Construction of TaqEFT-Tth(AKK) GL-G/M8 (DNA Sequence SEQ ID NO:2804; Amino Acid Sequence SEQ ID NO:2805)

Site specific mutagenesis was performed on Taq(EFT)-Tth(AKK) GL DNA (SEQ ID NO: 2790) using the mutagenic primers 1044-038-15: 5'-cac-gag-ttc-ggc-ctt-ctg-gga-ggg-gag-aag-ccc-cgg-gag-gag-gcc-ccc-tgg-ccc-3' and 1044-038-16: 5'-ggg-cca-ggg-ggc-ctc-ctc-ccg-ggg-ctt-ctc-ccc-tcc-cag-aag-gcc-gaa-ctc-gtg-3' (SEQ ID NO: 531 and 532, respectively) to introduce the E290G, S291G, P292E, A294P, and L295R mutations.

60. Construction of TaqEFT-Tth(AKK) GL-H/M9 (DNA Sequence SEQ ID NO:2806; Amino Acid Sequence SEQ ID NO:2807)

Site specific mutagenesis was performed on Taq(EFT)-Tth(AKK) GL DNA (SEQ ID NO: 2790) using the mutagenic primers 1044-038-17: 5'-ctg-gcc-ctg-gcc-gcc-tgc-agg-ggc-ggc-cgc-gtg-3' and 1044-038-18: 5'-cac-gcg-gcc-gcc-cct-gca-ggc-ggc-cag-ggc-cag-3' (SEQ ID NO: 535 and 536, respectively) to introduce the A328C mutation.

61. Construction of TaqEFT-Tth(AKK) GL-I/M10 (DNA Sequence SEQ ID NO:2808; Amino Acid Sequence SEQ ID NO:2809)

Site specific mutagenesis was performed on Taq(EFT)-Tth(AKK) GL DNA (SEQ ID NO: 2790) using the mutagenic primers 1080-015-01 (SEQ ID NO:539) 5'-ggg gag aag acg gcg agg aag ctt ctg aag gag tgg ggg agc-3' and 1080-015-02 (SEQ ID NO: 540) 5'-gct ccc cca ctc ctt cag aag ctt cct cgc cgt ctt ctc ccc-3' to introduce the E210 K mutation.

62. Construction of TaqEFT-Tth(AKK) GL-M1-9 (DNA Sequence SEQ ID NO:2810; Amino Acid Sequence SEQ ID NO:2811)

Seven independent PCR reactions were performed, using construct TaqEFT-Tth(AKK) GL (SEQ ID: 2790) as a template, with the following pairs of mutagenic primers: PCR Reaction 1; 1044-038-01 5'-cag-acc-atg-aat-tcg-gag-gcg-atg-ctg-ccc-ctc-ttt-3' (SEQ ID NO:507) and 1044-038-04 5'-gag-gcc-ctt-cag-ggc-aaa-gaa-ggt-gcg-gta-ggc-3' (SEQ ID NO:512) to yield a 108 base pair fragment, PCR Reaction 2; 1044-038-03 5'-gcc-tac-cgc-acc-ttc-ttt-gcc-ctg-aag-ggc-ctc-3' (SEQ ID NO: 511) and 1044-038-06 5'-cgc-gtc-ccc-gtc-ctc-tct-gag-ggc-ctt-gag-gag-3' (SEQ ID NO: 516) to yield a 117 base pair fragment, PCR Reaction 3; 1044-038-05 5'-ctc-ctc-aag-gcc-ctc-aga-gag-gac-ggg-gac-gcg-3' (SEQ ID NO: 515) and 1044-038-10 5'-cgc-ctt-ctt-ggc-cag-ggt-ggc-cag-gac-gtc-gtc-3' (SEQ ID NO: 520) to yield a 237 base pair fragment, PCR Reaction 4; 1044-038-09 5'-gac-gac-gtc-ctg-gcc-acc-ctg-gcc-aag-aag-gcg-3' (SEQ ID NO: 519) and 1044-038-12 5'-ctc-ctc-cag-aag-ctt-gag-cgc-cgt-ctt-ctc-ccc-3' (SEQ ID NO: 524) to yield a 276 base pair fragment, PCR Reaction 5; 1044-038-11 5'-ggg-gag-aag-acg-gcg-ctc-aag-ctt-ctg-gag-gag-3' (SEQ ID NO: 523) and 1044-038-14 5'-cct-ctc-cag-aaa-ggc-ctt-aag-ccc-ctc-ccg-gtc-ggg-ctc-3' (SEQ ID NO: 528) to yield a 228 base pair fragment, PCR Reaction 6; 1044-038-13 5'-gag-ccc-gac-cgg-gag-ggg-ctt-aag-gcc-ttt-ctg-gag-agg-3' (SEQ ID NO: 527) and 1044-038-16 5'-ggg-cca-ggg-ggc-ctc-ctc-ccg-ggg-ctt-ctc-ccc-tcc-cag-aag-gcc-gaa-ctc-gtg-3' (SEQ ID NO: 532) to yield a 113 base pair fragment, PCR Reaction 7; 1044-038-15 5'-cac-gag-ttc-ggc-ctt-ctg-gga-ggg-gag-aag-ccc-cgg-gag-gag-gcc-ccc-tgg-ccc-3' (SEQ ID NO: 531) and 1044-038-18 5'-cac-gcg-gcc-gcc-cct-gca-ggc-ggc-cag-ggc-cag-3' (SEQ ID NO: 536) to yield a 157 base pair fragment. The seven PCR products overlap such that PCR amplification in the absence of primers yielded the appropriate 1005 base pair product to introduce the K70E, G4EA, H29F, K57R, S125T, R206L, R269G, R271K, E290G, S291G, P292E, A294P, L295R, and A328C mutations. The product was further amplified using the outside primers: 1044-038-1 (SEQ ID NO: 507) and 1044-038-18 (SEQ ID NO: 536) and cloned into pPCR-Script-Amp. From this construct, the nuclease domain was again amplified using primers: 1044-038-1 (SEQ ID NO: 507) and 1044-038-18 (SEQ ID NO: 536) and digested with EcoRI and NotI. The digested PCR product was ligated into an EcoRI and NotI digested TaqEFT-Tth(AKK) GL construct and transformed into JM109 for protein expression and screening.

63. Construction of TaqEFT-Tth(AKK) GL-M1-10 (DNA Sequence SEQ ID NO:2812; Amino Acid Sequence SEQ ID NO:2813)

Seven independent PCR reactions were performed, using construct TaqEFT-Tth(AKK) GL (SEQ ID: 2790) as a template, with the following pairs of mutagenic primers: PCR Reaction 1; 1044-038-01 5'-cag-acc-atg-aat-tcg-gag-gcg-atg-ctg-ccc-ctc-ttt-3' (SEQ ID NO:507) and 1044-038-04 5'-gag-gcc-ctt-cag-ggc-aaa-gaa-ggt-gcg-gta-ggc-3' (SEQ ID NO:512) to yield a 108 base pair fragment, PCR Reaction 2; 1044-038-03 5'-gcc-tac-cgc-acc-ttc-ttt-gcc-ctg-aag-ggc-ctc-3' (SEQ ID NO: 511) and 1044-038-06 5'-cgc-gtc-ccc-gtc-ctc-tct-gag-ggc-ctt-gag-gag-3' (SEQ ID NO: 516) to yield a 117 base pair fragment, PCR Reaction 3; 1044-038-05 5'-ctc-ctc-aag-gcc-ctc-aga-gag-gac-ggg-gac-gcg-3' (SEQ ID NO: 515) and 1044-038-10 5'-cgc-ctt-ctt-ggc-cag-ggt-ggc-cag-gac-gtc-gtc-3' (SEQ ID NO: 520) to yield a 237 base pair fragment, PCR Reaction 4; 1044-038-09 5'-gac-gac-gtc-ctg-gcc-acc-ctg-gcc-aag-aag-gcg-3' (SEQ ID NO:

519) and 1080-42-02 5'-gc ttc cag gct ccc cca ctc ctt cag aag ctt gag cgc cgt ctt ctc ccc-3' (SEQ ID NO: 546) to yield a 299 base pair fragment, PCR Reaction 5; 1080-42-01 5'-ggg gag aag acg gcg ctc agg ctt ctg aag gag tgg ggg agc ctg gaa gc-3' (SEQ ID NO: 545) and 1044-038-14 5'-cct-ctc-cag-aaa-ggc-ctt-aag-ccc-ctc-ccg-gtc-ggg-ctc-3' (SEQ ID NO: 528) to yield a 228 base pair fragment, PCR Reaction 6; 1044-038-13 5'-gag-ccc-gac-cgg-gag-ggg-ctt-aag-gcc-ttt-ctg-gag-agg-3' (SEQ ID NO: 527) and 1044-038-16 5'-ggg-cca-ggg-ggc-ctc-ctc-ccg-ggg-ctt-ctc-ccc-tcc-cag-aag-gcc-gaa-ctc-gtg-3' (SEQ ID NO: 532) to yield a 113 base pair fragment, PCR Reaction 7; 1044-038-15 5'-cac-gag-ttc-ggc-ctt-ctg-gga-ggg-gag-aag-ccc-cgg-gag-gag-gcc-ccc-tgg-ccc-3' (SEQ ID NO: 531) and 1044-038-18 5'-cac-gcg-gcc-gcc-cct-gca-ggc-ggc-cag-ggc-cag-3' (SEQ ID NO: 536) to yield a 157 base pair fragment. The seven PCR products overlap such that PCR amplification in the absence of primers yielded the appropriate 1005 base pair product to introduce the K70E, G4EA, H29F, K57R, S125T, R206L, E210K, R269G, R271K, E290G, S291G, P292E, A294P, L295R, and A328C mutations. The product was further amplified using the outside primers: 1044-038-1 (SEQ ID NO: 507) and 1044-038-18 (SEQ ID NO: 536) and cloned into pPCR-Script-Amp. From this construct, the nuclease domain was again amplified using primers: 1044-038-1 (SEQ ID NO: 507) and 1044-038-18 (SEQ ID NO: 536) and digested with EcoRI and NotI. The digested PCR product was ligated into an EcoRI and NotI digested TaqEFT-Tth(AKK) GL construct and transformed into JM109 for enzyme expression and screening.

64. Construction of Tth(K69E)AKK, Taq(K69E)TthAKK, Tfi(K69E)TthAKK and Tsc(K69E)TthAKK and Mutants Site specific mutagenesis was performed on TthAKK GL, TaqTthAKK GL, TfiTthAKK GL and TscTthAKK GL DNAs using the mutagenic primers 5'-atc-gtg-gtc-ttt-gac-gcc-gag-gcc-ccc-tcc-ttc-c-3' (SEQ ID NO: 492) and 5'-gga-agg-agg-ggg-cct-cgg-cgt-caa-aga-cca-cga-t-3' (SEQ ID NO: 493) to introduce the K69E mutation and to generate Tth(K69E)AKK GL (DNA sequence SEQ ID NO:2763; amino acid sequence SEQ ID NO:2783), Taq(K69E)TthAKK GL, (DNA sequence SEQ ID NO:2784; amino acid sequence SEQ ID NO:2785), Tfi(K69E)TthAKK GL (DNA sequence SEQ ID NO:2786; amino acid sequence SEQ ID NO:2787) and Tsc(K69E)TthAKK GL (DNA sequence SEQ ID NO:2788; amino acid sequence SEQ ID NO:2789) mutant enzymes.

65. Construction of Tsc(167–334)TthAKK GL

Two overlapping PCR fragments were generated by primers 390-76-08: 5'-tgt-gga-att-gtg-agc-gg-3' (SEQ ID NO:314) and 1044-041-01: 5'-ctt-ctc-tca-tcc-gcc-aaa-aca-gcc-3' (SEQ ID NO: 451) with template Tth(K69E)AKK GL, (DNA sequence SEQ ID NO:2763), and primers 1044-041-02: 5'-ctc-ctc-cac-gag-ttc-ggc-3' (SEQ ID NO: 453) and 209-074-02: 5'-gtg-gcc-tcc-ata-tgg-gcc-agg-ac-3' (SEQ ID NO:316) with template Tsc(K69E)TthAKK GL, (DNA sequence SEQ ID NO:2764). Two products were combined and amplified with outside primers 390-76-08 and 209-074-02. The recombinant PCR product was cut with the restriction enzymes EcoRI and NotI and ligated into the vector TthAKK GL which was prepared by cutting with the same enzymes to yield Tsc(167–333)TthAKK GL construct (DNA sequence SEQ ID NO:2765; amino acid sequence SEQ ID NO:2766).

66. Construction of Tsc(222–334)TthAKK GL

Two overlapping PCR fragments were generated by primers 390-76-08: 5'-tgt-gga-att-gtg-agc-gg-3' (SEQ ID NO:314) and 1044-041-03: 5'-ttc-cag-gtg-ctt-gag-gag-gtt-ttc-cag-3' (SEQ ID NO: 457) with template Tth(K69E)AKK GL (DNA sequence SEQ ID NO:2763), and primers 1044-041-04: 5'-ctc-ctc-aag-cac-ctg-gaa-cag-gtg-aaa-3' (SEQ ID NO: 458) and 209-074-02: 5'-gtg-gcc-tcc-ata-tgg-gcc-agg-ac-3' (SEQ ID NO:316) with template Tsc(K69E)TthAKK GL, (DNA sequence SEQ ID NO:2764). Two products were combined and amplified with outside primers 390-76-08 and 209-074-02. The recombinant PCR product was cut with the restriction enzymes EcoRI and NotI and ligated into the vector TthAKK GL which was prepared by cutting with the same enzymes to yield Tsc(222–334)TthAKK GL construct (DNA sequence SEQ ID NO:2767; amino acid sequence SEQ ID NO:2768).

67. Construction of Tfi(222–334)TthAKK GL

Two overlapping PCR fragments were generated by primers 390-76-08: 5'-tgt-gga-att-gtg-agc-gg-3' (SEQ ID NO:314) and 1044-058-05: 5'-gtc-cag-gtt-ctt-gag-gag-gtt-ttc-cag-3' (SEQ ID NO: 461) with template Tth(K69E)AKK GL (DNA sequence SEQ ID NO:2763), and primers 1044-058-06: 5'-ctc-ctc-aag-aac-ctg-gac-cgg-gta-aag-3' (SEQ ID NO: 462) and 209-074-02: 5'-gtg-gcc-tcc-ata-tgg-gcc-agg-ac-3' (SEQ ID NO:316) with template Tfi(K69E)TthAKK GL (DNA sequence SEQ ID NO:2786). Two products were combined and amplified with outside primers 390-76-08 and 209-074-02. The recombinant PCR product was cut with the restriction enzymes EcoRI and NotI and ligated into the vector TthAKK GL which was prepared by cutting with the same enzymes to yield Tfi(222–334)TthAKK GL construct (DNA sequence SEQ ID NO:2769; amino acid sequence SEQ ID NO:2770).

68. Construction of Tfi(167–334)TthAKK GL

Two overlapping PCR fragments were generated by primers 390-76-08 5'-tgt-gga-att-gtg-agc-gg-3' (SEQ ID NO:314) and 1044-058-07 5'-gac-gtc-ctt-cgg-ggt-gat-gag-gtg-gcc-3' (SEQ ID NO: 465) with template Tth(K69E)AKK GL, (DNA sequence SEQ ID NO:2763), and primers 1044-058-08 5'-atc-acc-ccg-aag-gac-gtc-cag-gag-aag-3' (SEQ ID NO: 466) and 209-074-02 5'-gtg-gcc-tcc-ata-tgg-gcc-agg-ac-3' (SEQ ID NO:316) with template Tfi(K69E)TthAKK GL, (DNA sequence SEQ ID NO:2787). Two products were combined and amplified with outside primers 390-76-08 and 209-074-02. The recombinant PCR product was cut with the restriction enzymes EcoRI and NotI and ligated into the vector TthAKK GL which was prepared by cutting with the same enzymes to yield Tfi(167–333)TthAKK GL construct (DNA sequence SEQ ID NO: 2771; amino acid sequence SEQ ID NO:2772).

69. Construction of Tsc(111–334)TthAKK GL

Two overlapping PCR fragments were generated by primers 390-76-08 5'-tgt-gga-att-gtg-agc-gg-3' (SEQ ID NO:314) and 1044-058-01 5'-ctc-gag-gcg-ggt-aaa-ccc-cag-gag-gtc-3' (SEQ ID NO: 469) with template Tth(K69E)AKK GL (DNA sequence SEQ ID NO:2763), and primers 1044-058-02 5'-ggg-ttt-acc-cgc-ctc-gag-gtg-ccc-ggc-3' (SEQ ID NO: 470) and 209-074-02 5'-gtg-gcc-tcc-ata-tgg-gcc-agg-ac-3' (SEQ ID NO:316) with template Tsc(K69E)TthAKK GL (DNA sequence SEQ ID NO:2788). Two products were combined and amplified with outside primers 390-76-08 and 209-074-02. The recombinant PCR product was cut with the restriction enzymes EcoRI and NotI and ligated into the vector TthAKK GL which was prepared by cutting with the same enzymes to yield Tsc(167–333)TthAKK GL construct (DNA sequence SEQ ID NO:2773; amino acid sequence SEQ ID NO:2774).

70. Construction of Tsc(1–167)TthAKK GL

Two overlapping PCR fragments were generated by primers 390-76-08 5'-tgt-gga-att-gtg-agc-gg-3' (SEQ ID NO:314) and 1044-058-03 5'-aag-cca-ctc-cgg-ggt-gat-cag-gta-acc-3' (SEQ ID NO: 473) with template Tsc(K69E) TthAKK GL (DNA sequence SEQ ID NO:2788), and primers 1044-058-04 5'-atc-acc-ccg-gag-tgg-ctt-tgg-gag-aag-3' (SEQ ID NO: 474) and 209-074-02 5'-gtg-gcc-tcc-ata-tgg-gcc-agg-ac-3' (SEQ ID NO:316) with template Tth(K69E) AKK GL (DNA sequence SEQ ID NO:2763). Two products were combined and amplified with outside primers 390-76-08 and 209-074-02. The recombinant PCR product was cut with the restriction enzymes EcoRI and NotI and ligated into the vector TthAKK GL which was prepared by cutting with the same enzymes to yield Tsc(1–167)TthAKK GL construct (DNA sequence SEQ ID NO:2775; amino acid sequence SEQ ID NO:2776).

71. Construction of Afu336-Tth296(AKK) GL, AT1-1

Two overlapping PCR fragments were generated. The first fragment was made using the AfuFEN construct (SEQ ID NO:556) as template with the primers: 390-076-08 5'-tgt-gga-att-gtg-agc-gg-3' (SEQ ID NO:314) and 390-065-05 5'-gaa-cca-cct-ctc-aag-cgt-gg-3' (SEQ ID NO: 554). The second fragment was made using TthAKK GL (SEQ ID NO:2702) as template and the primers: 700-049-01 5'-acg-ctt-gag-agg-tgg-ttc-ctg-gag-gag-gc-ccc-tgg-3' (SEQ ID NO: 555) and 390-076-09 5'-taa-tct-gta-tca-ggc-tg-3' (SEQ ID NO:557). The two products contain a region of sequence overlap, and were combined and amplified with outside primers 390-076-08 and 390-076-09 in a recombinant PCR reaction. The recombinant PCR product was cut with the restriction enzymes BspEI and SalI and ligated into the AfuFEN construct which was prepared by cutting with the same enzymes to yield Afu336-Tth296(AKK) GL construct (DNA sequence SEQ ID NO:2814; amino acid sequence SEQ ID NO:2815).

72. Construction of Afu328-Tth296(AKK) GL, AT2-3

Two overlapping PCR fragments were generated, the first by primers: 390-076-08 5'-tgt-gga-att-gtg-agc-gg-3' (SEQ ID NO:314) and 700-049-02 5'-ggt-tga-ctt-cag-agc-ttt-gag-3' (SEQ ID NO: 561) with template AfuFEN (DNA sequence SEQ ID NO:556), and the second by primers: 700-049-03 5'-aaa-gct-ctg-aag-tca-acc-ctg-gag-gag-gcc-ccc-tgg-3' (SEQ ID NO: 562) and 390-076-09 5'-taa-tct-gta-tca-ggc-tg-3' (SEQ ID NO:557) with template TthAKK GL (DNA sequence SEQ ID NO:2702). The two products were combined and amplified with outside primers 390-076-08 and 390-076-09. The recombinant PCR product was cut with the restriction enzymes BspEI and SalI and ligated into the vector pAfuFEN which was prepared by cutting with the same enzymes to yield Afu336-Tth296(AKK) GL construct (DNA sequence SEQ ID NO:2816; amino acid sequence SEQ ID NO:2817).

The procedure for random chimerization desribed above was used to develop the following chimeras.

73. Generation of Random Chimeras S26 and S36

The templates used to develop these chimeric enzymes were the nuclease domains from TthAKK GL, TaqTthAKK GL, TscTthAKK GL and the TfiTthAKK GL constructs. Two clones were found to show improvement of activity based on primary activity screening. Random chimeras S26 GL (DNA sequence SEQ ID NO:2818; amino acid sequence SEQ ID NO:2819) and S36 (DNA sequence SEQ ID NO:2820; amino acid sequence SEQ ID NO:2821) were then sequenced and isolated.

74. Construction of S26(FT) GL

Site specific mutagenesis was performed on pS26 GL DNA using the mutagenic primers: 785-008-03 5'-ttt-acc-cgc-ctc-gag-gtg-ccg-ggc-3' (SEQ ID NO: 489) and 680-21-03 5'-cgg-cac-ctc-gag-gcg-ggt-aaa-gcc-caa-aag-gtc-cac-3' (SEQ ID NO: 490) to introduce the L107F/E108T mutations and generate S26(FT) GL (DNA sequence SEQ ID NO:2822; amino acid sequence SEQ ID NO:2823).

75. Construction of S36(FT) GL

Site specific mutagenesis was performed on pS36 GL DNA using the mutagenic primers: 785-096-01: 5'-gtg-gac-ctt-ctg-ggc-ttt-acc-cgc-ctc-gag-gcc-ccg-3' (SEQ ID NO: 486) and 785-096-02: 5'-cgg-ggc-ctc-gag-gcg-ggt-aaa-gcc-cag-aag-gtc-cac-3' (SEQ ID NO: 487) to introduce the L109F/V110T mutations and generate S36(FT) GL (DNA sequence SEQ ID NO: 2824; amino acid sequence SEQ ID NO:2825).

76. Construction of S26(K69E) GL

Site specific mutagenesis was performed on S26 GL DNA using the mutagenic primers: 5'-atc-gtg-gtc-ttt-gac-gcc-gag-gcc-ccc-tcc-ttc-c-3' (SEQ ID NO: 492) and 5'-gga-agg-agg-ggg-cct-cgg-cgt-caa-aga-cca-cga-t-3' (SEQ ID NO: 493) to introduce the K69E mutation and to generate S26(K69E) GL (DNA sequence SEQ ID NO:2826; amino acid sequence SEQ ID NO:2827).

77. Construction of S26(FT/K69E) GL

Site specific mutagenesis was performed on S26(FT) GL DNAs using the mutagenic primers: 5'-atc-gtg-gtc-ttt-gac-gcc-gag-gcc-ccc-tcc-ttc-c-3' (SEQ ID NO: 492) and 5'-agg-agg-ggg-cct-cgg-cgt-caa-aga-cca-cga-t-3' (SEQ ID NO: 493) to introduce the K69E mutation and to generate S26 (FT/K69E) GL (DNA sequence SEQ ID NO:2828; amino acid sequence SEQ ID NO:2829).

78. More Random Chimeras, N3D7, N1A12 N1C4, and N2C3

The templates used to generate these chimerics were the nuclease domains of Tth(K69E)AKK GL, Taq(K69E) TthAKK GL, Tsc(K69E)TthAKK GL and Tfi(K69E) TthAKK GL constructs. Four clones were shown to have improved activity based on the primary activity screening. Random chimeras N3D7 GL (DNA sequence SEQ ID NO:2830; amino acid sequence SEQ ID NO:2831), N1A12 GL (DNA sequence SEQ ID NO:2832; amino acid sequence SEQ ID NO:2833), N1C4 GL (DNA sequence SEQ ID NO:2834; amino acid sequence SEQ ID NO:2835) and N2C3 GL (DNA sequence SEQ ID NO:2836; amino acid sequence SEQ ID NO:2837) were then sequenced and isolated respectively.

Generation of DL, GR and DR Variants of TthAKK GL Enzyme

A series of TthAKK GL variants having a Gly to Asp change at amino acid 385 (G385D) and/or a Leu to Arg change at amino acid 455 (L455R), were created by site-directed mutagenesis. Constructs comprising both of these two amino acid variations is indicated as "DR". Chimeras comprising only one variation are indicated as either 'DL' or 'GR'.

1. Construction of TthAKK DL Mutant

Site specific mutagenesis was performed on pTrc99A TthAKK GL DNA (SEQ ID NO: 2702) using the mutagenic primers 1144-60-01, 5'-cgc-cta-cct-cct-gga-ccc-ttc-gaa-cac-cac-c-3' (SEQ ID NO:2858) and 1144-60-02, 5'-ggt-ggt-gtt-cga-agg-gtc-cag-gag-gta-ggc-g-3' (SEQ ID NO:2859) to introduce the G383D mutation to yield TthAKK DL (DNA sequence SEQ ID NO:2838; amino acid sequence SEQ ID NO:2839).

2. Construction of TthAKK GR Mutant

Site specific mutagenesis was performed on pTrc99A TthAKK GL DNA (SEQ ID NO: 2702) using the mutagenic primers 1144-60-03, 5'-ggt-acg-gcg-gga-cgt-ggc-cta-cct-tca-g-3' (SEQ ID NO:2860) and 1144-60-04, 5'-ctg-aag-gta-ggc-cac-gtc-ccg-tac-c-3' (SEQ ID NO:2861) to introduce the L453R mutation to yield TthAKK GR (DNA sequence SEQ ID NO:2840; amino acid sequence SEQ ID NO:2841).

3. Construction of TthAKK DR Mutant

Site specific mutagenesis was performed on pTrc99A TthAKK GL DNA (SEQ ID NO: 2702) using the mutagenic primers 1144-60-01, 1144-60-02, 1144-60-03 and 1144-60-04 (SEQ ID NOS:2858, 2859, 2860 and 2861, respectively) to introduce the G383D and L453R mutations to yield TthAKK DR mutant (DNA sequence SEQ ID NO:2842; amino acid sequence SEQ ID NO:2843).

4. Construction of TthAKK(F29R) GL

Site specific mutagenesis was performed on pTrc99A TthAKK GL DNA (SEQ ID NO: 2702) using the mutagenic primers 1249-26-01, 5'-cac-ctg-gcc-tac-cgc-acc-cgc-ttc-gcc-ctg-aag-ggc-ctc-3' (SEQ ID NO:2862) and 1249-26-02, 5'-gag-gcc-ctt-cag-ggc-gaa-gcg-ggt-gcg-gta-ggc-cag-gtg-3' (SEQ ID NO:2863) to introduce the F29R mutation to yield the TthAKK(F29R) GL mutant (DNA sequence SEQ ID NO:2844; amino acid sequence SEQ ID NO:2845).

5. Construction of TthAKK(F29R/F30H) GL

Site specific mutagenesis was performed on pTrc99A TthAKK GL DNA (SEQ ID NO: 2702) using the mutagenic primers 1249-26-03, 5'-cac-ctg-gcc-tac-cgc-acc-cgc-cac-gcc-ctg-aag-ggc-ctc-acc-3' (SEQ ID NO:2864) and 1249-26-04, 5'-ggt-gag-gcc-ctt-cag-ggc-gtg-gcg-ggt-gcg-gta-ggc-cag-gtg-3' (SEQ ID NO:2865) to introduce the F29R/F30H mutations to yield the TthAKK(F29R/F30H) GL mutant (DNA sequence SEQ ID NO:2846; amino acid sequence SEQ ID NO:2847).

6. Construction of TthAKK(F29R/F30R) GL

Site specific mutagenesis was performed on pTrc99A TthAKK GL DNA (SEQ ID NO: 2702) using the mutagenic primers 1249-26-05, 5'-cac-ctg-gcc-tac-cgc-acc-cgc-cgc-gcc-ctg-aag-ggc-ctc-acc-3' (SEQ ID NO:2866) and 1249-26-06, 5'-ggt-gag-gcc-ctt-cag-ggc-gcg-gcg-ggt-gcg-gta-ggc-cag-gtg-3' (SEQ ID NO:2867) to introduce the F29R/F30R mutations to yield the TthAKK(F29R/F30R) GL mutant (DNA sequence SEQ ID NO:2848; amino acid sequence SEQ ID NO:2849).

7. Construction of Tsc(F26R)TthAKK GL

Site specific mutagenesis was performed on pTrc99A TscTth(AKK) GL DNA (SEQ ID NO: 2708) using the mutagenic primers 1249-26-01, 5'-cac-ctg-gcc-tac-cgc-acc-cgc-tc-gcc-ctg-aag-ggc-ctc-3' (SEQ ID NO:2862) and 1249-26-02, 5'-gag-gcc-ctt-cag-ggc-gaa-gcg-ggt-gcg-gta-ggc-cag-gtg-3' (SEQ ID NO:2863) to introduce the F26R mutation to yield the Tsc(F26R)TthAKK GL mutant (DNA sequence SEQ ID NO:2850; amino acid sequence SEQ ID NO:2851).

8. Construction of Tsc(F26R/F27H)TthAKK GL

Site specific mutagenesis was performed on pTrc99A TscTthAKK GL DNA (SEQ ID NO: 2708) using the mutagenic primers 1249-26-03, 5'-cac-ctg-gcc-tac-cgc-acc-cgc-cac-gcc-ctg-aag-ggc-ctc-acc-3' (SEQ ID NO:2864) and 1249-26-04, 5'-ggt-gag-gcc-ctt-cag-ggc-gtg-gcg-ggt-gcg-gta-ggc-cag-gtg-3' (SEQ ID NO:2865) to introduce the F26R/F27H mutations to yield the Tsc(F26R/F27H) TthAKK GL mutant (DNA sequence SEQ ID NO:2852; amino acid sequence SEQ ID NO:2853).

9. Construction of Tsc(F26R/F27R)TthAKK GL

Site specific mutagenesis was performed on pTrc99A TscTthAKK GL DNA (SEQ ID NO: 2708) using the mutagenic primers 1249-26-05, 5'-cac-ctg-gcc-tac-cgc-acc-cgc-cgc-gcc-ctg-aag-ggc-ctc-acc-3' (SEQ ID NO:2866) and 1249-26-06, 5'-ggt-gag-gcc-ctt-cag-ggc-gcg-gcg-ggt-gcg-gta-ggc-cag-gtg-3' (SEQ ID NO:2867) to introduce the F26R/F27R mutations to yield the Tsc(F26R/F27R)TthAKK GL mutant (DNA sequence SEQ ID NO:2854; amino acid sequence SEQ ID NO:2855).

10. Construction of Taq(F28R)TthAKK GL

Site specific mutagenesis was performed on pTrc99A-TaqTthAKK GL DNA (SEQ ID NO: 2706) using the mutagenic primers 1249-26-03, 5'-cac-ctg-gcc-tac-cgc-acc-cgc-cac-gcc-ctg-aag-ggc-ctc-acc-3' (SEQ ID NO:2864) and 1249-26-04, 5'-ggt-gag-gcc-ctt-cag-ggc-gtg-gcg-ggt-gcg-gta-ggc-cag-gtg-3' (SEQ ID NO:2865) to introduce the F28R mutation and generate Taq(F28R)TthAKK GL mutant (DNA sequence SEQ ID NO:2856; amino acid sequence SEQ ID NO:2857).

Example 10

Figure 26:
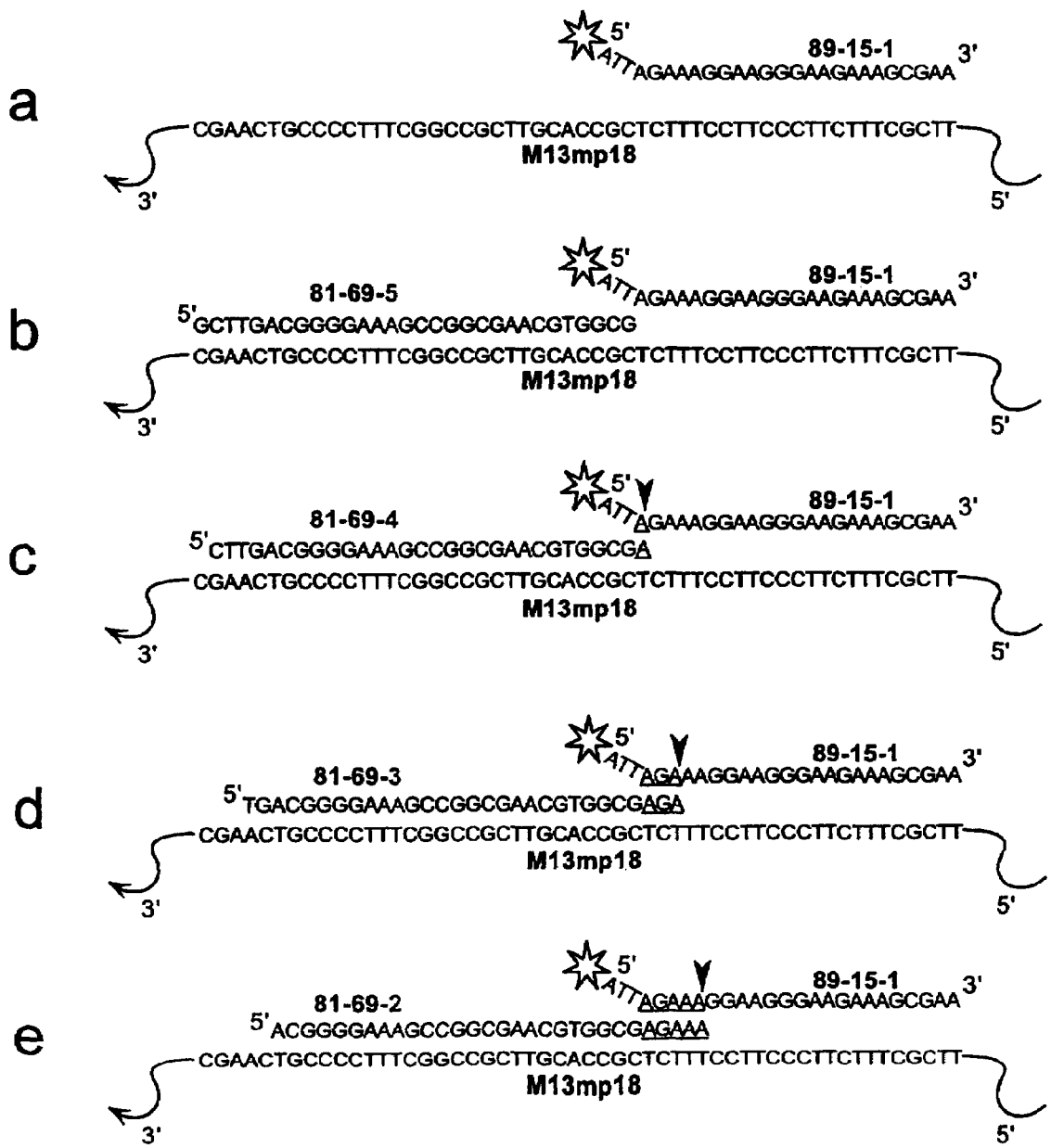
FIG. 26 depicts structures that may be employed to determine the ablity of an enzyme to cleave a probe in the presence and the absence of an upstream oligonucleotide.

Test for the Dependence of an Enzyme on the Presence of an Upstream Oligonucleotide When choosing a structure-specific nuclease for use in a sequential invasive cleavage reaction it is preferable that the enzyme have little ability to cleave a probe 1) in the absence of an upstream oligonucleotide, and 2) in the absence of overlap between the upstream oligonucleotide and the downstream probe oligonucleotide. FIGS. 26a–e depicts several structures that can be used to examine the activity of an enzyme is confronted with each of these types of structures. The structure a (FIG. 26a) shows the alignment of a probe oligonucleotide with a target site on bacteriophage M13 DNA (M13 sequences shown in FIG. 26 are provided in SEQ ID NO:217) in the absence of an upstream oligonucleotide. Structure b (FIG. 26b) is provided with an upstream oligonucleotide that does not contain a region of overlap with the labeled probe (the label is indicated by the star). In structures c, d and e (FIGS. 26c–e) the upstream oligonucleotides have overlaps of 1, 3 or 5 nucleotides, respectively, with the downstream probe oligonucleotide and each of these structures represents a suitable invasive cleavage structure. The enzyme Pfu FEN-1 was tested for activity on each of these structures and all reactions were performed in duplicate.

Each reaction comprised 1 µM 5' TET labeled probe oligonucleotide 89-15-1 (SEQ ID NO:212), 50 nM upstream oligonucleotide (either oligo 81-69-2 [SEQ ID NO:216], oligo 81-69-3 [SEQ ID NO:215], oligo 81-69-4 [SEQ ID NO:214], oligo 81-69-5 [SEQ ID NO:213], or no upstream oligonucleotide), 1 fmol M13 target DNA, 10 mg/ml tRNA and 10 ng of Pfu FEN-1 in 10 µl of 10 mM MOPS (pH 7.5), 7.5 mM $MgCl_2$ with 0.05% each of Tween 20 and Nonidet P-40.

All of the components except the enzyme and the $MgCl_2$ were assembled in a final volume of 8 µl and were overlaid with 10 µl of CHILLOUT liquid wax. The samples were heated to the reaction temperature of 69° C. The reactions were started by the addition of the Pfu FEN-1 and $MgCl_2$, in a 2 µl volume. After incubation at 69° C. for 30 minutes, the reactions were stopped with 10 µl of 95% formamide, 10 mM EDTA, 0.02% methyl violet. Samples were heated to 90° C. for 1 min immediately before electrophoresis through a 20% denaturing acrylamide gel (19:1 cross-linked), with 7

M urea, in a buffer of 45 mM Tris-Borate, pH 8.3, 1.4 mM EDTA. Gels were then analyzed with a FMBIO-100 Hitachi FMBIO fluorescence imager. The resulting image is displayed in FIG. 27.

Figure 27:
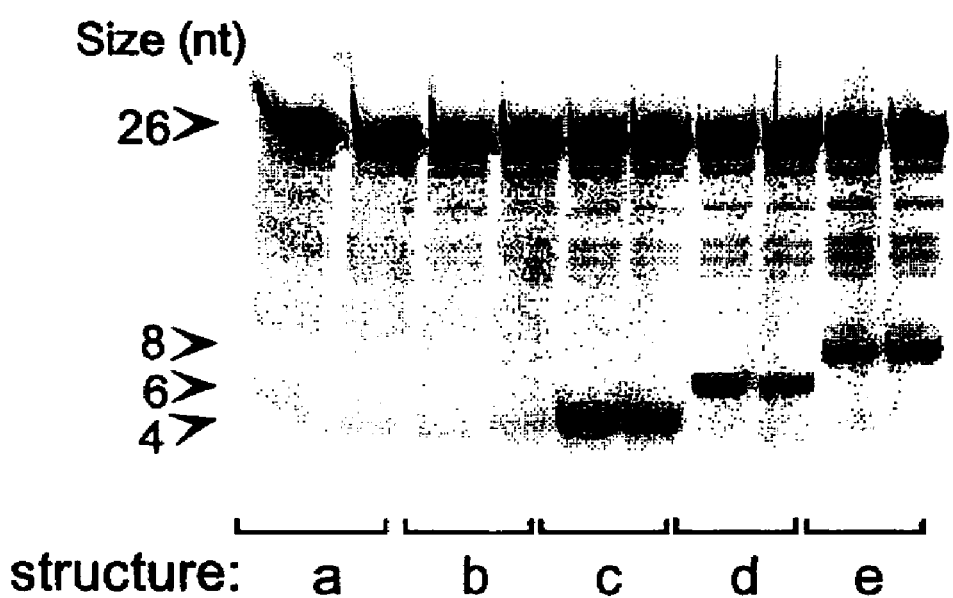
FIG. 27 shows the image generated by a fluorescence imager that shows the dependence of Pfu FEN-1 on the presence of an overlapping upstream oligonucleotide for specific cleavage of the probe.

In FIG. 27, lanes labeled "a" contain the products generated from reactions conducted without an upstream oligonucleotide (structure a), lanes labeled "b" contain an upstream oligonucleotide that does not invade the probe/target duplex (structure b). Lanes labeled "c", "d" and "e" contain the products generated from reactions conducted using an upstream oligonucleotide that invades the probe/target duplex by 1, 3 or 5 bases, respectively. The size (in nucleotides) of the uncleaved probe and the cleavage products is indicated to the left of the image in FIG. 27. Cleavage of the probe was not detectable when structures a and b were utilized. In contrast, cleavage products were generated when invasive cleavage structures were utilized (structures c–e). These data show that the Pfu FEN-1 enzyme requires an overlapping upstream oligonucleotide for specific cleavage of the probe.

Any enzyme may be examined for its suitability for use in a sequential invasive cleavage reaction by examining the ability of the test enzyme to cleave structures a–e (it is understood by those in the art that the specific oligonucleotide sequences shown in FIGS. 26a–e need not be employed in the test reactions; these structures are merely illustrative of suitable test structures). Desirable enzymes display little or no cleavage of structures a and b and display specific cleavage of structures c–e (i.e., they generate cleavage products of the size expected from the degree of overlap between the two oligonucleotides employed to form the invasive cleavage structure).

Example 11

Use of the Products of a First Invasive Cleavage Reaction to Enable a Second Invasive Cleavage Reaction with a Net Gain in Sensitivity As discussed in the Description of The Invention above, the detection sensitivity of the invasive cleavage reaction can be increased by the performing a second round of invasive cleavage using the products of the first reaction to complete the cleavage structure in the second reaction. In this Example, the use of a probe that, when cleaved in a first invasive cleavage reaction, forms an integrated INVADER oligonucleotide and target molecule for use in a second invasive cleavage reaction, is illustrated.

A first probe was designed to contain some internal complementarity so that when cleaved in a first invasive cleavage reaction the product ("Cut Probe 1") could form a target strand comprising an integral INVADER oligonucleotide. A second probe was provided in the reaction that would be cleaved at the intended site when hybridized to the newly formed target/INVADER molecule. To demonstrate the gain in signal due to the performance of sequential invasive cleavages, a standard invasive cleavage assay, as described above, was performed in parallel.

All reactions were performed in duplicate. Each standard (i.e., non-sequential) invasive cleavage reaction comprised 1 µM 5' fluorescein-labeled probe oligo 073–182 (5' Fl-AGAAAGGAAGGGAAGAAAGCGAA-3'; SEQ ID NO:591), 10 nM upstream oligo 81-69-4 (5'-CTTGACGGGGAAAGCCGGCGAACGTGGCGA-3'; SEQ ID NO:214), 10 to 100 attomoles of M13 target DNA, 10 mg/ml tRNA and 10 ng of Pfu FEN-1 in 10 µl of 10 mM MOPS (pH 7.5), 8 mM MgCl$_2$ with 0.05% each of Tween 20 and Nonidet P-40. All of the components except the enzyme and the MgCl$_2$ were assembled in a volume of 7 µl and were overlaid with 10 µl of CHILLOUT liquid wax. The samples were heated to the reaction temperature of 62° C. The reactions were started by the addition of the Pfu FEN-1 and MgCl$_2$, in a 2 µl volume. After incubation at 62° C. for 30 minutes, the reactions were stopped with 10 µl of 95% formamide, 10 mM EDTA, 0.02% methyl violet.

Each sequential invasive cleavage reaction comprised 1 µM 5' fluorescein-labeled oligonucleotide 073-191 (the first probe or "Probe 1", 5' Fl-TGGAGGTCAAAACATCG ATAAGTCGAAGAAAGGAAGGGAAGAAAT-3'; SEQ ID NO:592), 10 nM upstream oligonucleotide 81-69-4 (5'-CTTGACGGGGAAA GCCGGCGAACGTGGCGA-3'; SEQ ID NO:214), 1 µM of 5' fluorescein labeled oligonucleotide 106-32 (the second probe or "Probe 2", 5Fl-TGTTTTGACCT CCA-3'; SEQ ID NO:593), 1 to 100 amol of M13 target DNA, 10 mg/ml tRNA and 10 ng of Pfu FEN-1 in 10 µl of 10 mM MOPS (pH 7.5), 8 mM MgCl$_2$ with 0.05% each of Tween 20 and Nonidet P-40. All of the components except the enzyme and the MgCl$_2$ were assembled in a volume of 8 µl and were overlaid with 10 µl of CHILLOUT liquid wax. The samples were heated to the reaction temperature of 62° C. (this temperature is the optimum temperature for annealing of Probe 1 to the first target). The reactions were started by the addition of Pfu FEN-1 and MgCl$_2$, in a 2 µl volume. After incubation at 62° C. for 15 minutes, the temperature was lowered to 58° C. (this temperature is the optimum temperature for annealing of Probe 2 to the second target) and the samples were incubated for another 15 min. Reactions were stopped by the addition of 10 µl of 95% formamide, 20 mM EDTA, 0.02% methyl violet.

Samples from both the standard and the sequential invasive cleavage reactions were heated to 90° C. for 1 min immediately before electrophoresis through a 20% denaturing acrylamide gel (19:1 cross-linked), with 7 M urea, in a buffer of 45 mM Tris-Borate, pH 8.3, 1.4 mM EDTA. The gel was then analyzed with a Molecular Dynamics FluorImager 595. The resulting image is displayed in FIG. 28a. A graph showing measure of fluorescence intensity for each of the product bands is shown in FIG. 28b.

In FIG. 28a, lanes 1–5 contain the products generated in standard invasive cleavage reactions that contained either no target (lane 1), 10 amol of target (lanes 2 and 3) or with 100 amol of target (lanes 4 and 5). The uncleaved probe is seen as a dark band in each lane about half way down the panel and the cleavage products appear as a smaller black band near the bottom of the panel, the position of the cleavage product is indicated by an arrow head to the left of FIG. 28a. The gray ladder of bands seen in lanes 1–5 is due to the thermal degradation of the probe and is not related to the presence or absence of the target DNA. The remaining lanes display products generated in sequential invasive cleavage reactions that contained 1 amol of target (lanes 6 and 7), 10 amol of target (lanes 8 and 9) and 100 amol of target (lanes 10 and 11). The uncleaved first probe (Probe 1; labeled "1 uncut") is seen near the top of the panel, while the cleaved first probe is indicated as "1: cut". Similarly, the uncleaved and cleaved second probe are indicated as "2: uncut" and 2: cut," respectively.

The graph shown in FIG. 28b compares the amount of product generated from the standard reaction ("Series 1") to the amount of product generated from the second step of the sequential reaction ("Series 2"). The level of background fluorescence measured from a reaction that lacked target DNA was subtracted from each measurement. It can be seen from the table located below the graph that the signal from the standard invasive cleavage assay that contained 100 attomoles of target DNA was nearly identical to the signal from the sequential invasive cleavage assay in which 1 attomole of target was present, indicating that the inclusion of a second cleavage structure increases the sensitivity of the assay 100 to 200-fold. This boost in signal allows easy detection of target nucleic acids at the sub attomole level using the sequential invasive cleavage assay, while the standard assay, when performed using this enzyme for only 30 minutes, does not generate detectable product in the presence of 10 attomoles of target.

When the amount of target was decreased by 10 or 100 fold in the sequential invasive cleavage assay, the intensity of the signal was decreased by the same proportion. This indicates that the quantitative capability of the invasive cleavage assay is retained even when reactions are performed in series, thus providing a nucleic acid detection method that is both sensitive and quantitative.

While in this Example, the two probes used had different optimal hybridization temperatures (i.e., the temperature empirically determined to give the greatest turnover rate in the given reaction conditions), the probes may also be selected (i.e., designed) to have the same optimal hybridization temperature so that a temperature shift during incubation is not necessary.

Example 12

The Products of a Completed Sequential Invasive Cleavage Reaction cannot Cross Contaminate Subsequent Similar Reactions As discussed in the Description of the Invention, the serial nature of the multiple invasive cleavage events that occur in the sequential invasive cleavage reaction, in contrast to the reciprocating nature of the polymerase chain reaction and similar doubling assays, means that the sequential invasive cleavage reaction is not subject to contamination by the products of like reactions because the products of the first cleavage reaction do not participate in the generation of new signal in the second cleavage reaction. If a large amount of a completed reaction were to be added to a newly assembled reaction, the background that would be produced would come from the amount of target that was also carried in, combined with the amount of already-cleaved probe that was carried in. In this Example, it is demonstrated that a very large portion of a primary reaction must be introduced into the secondary reaction to create significant signal.

A first or primary sequential invasive cleavage reaction was performed as described above using 100 amol of target DNA. A second set of 5 reactions were assembled as described in Ex. 11 with the exception that portions of the first reaction were introduced and no additional target DNA was included. These secondary reactions were initiated and incubated as described above, and included 0, 0.01, 0.1, 1, or 10% of the first reaction material. A control reaction including 100 amol of target was included in the second set also. The reactions were stopped, resolved by electrophoresis and visualized as described above, and the resulting image is displayed in FIG. 29. The primary probe, uncut second probe and the cut 2nd probe are indicated on the left as "1: cut", 2: uncut" and 2: cut", respectively.

Figure 29:
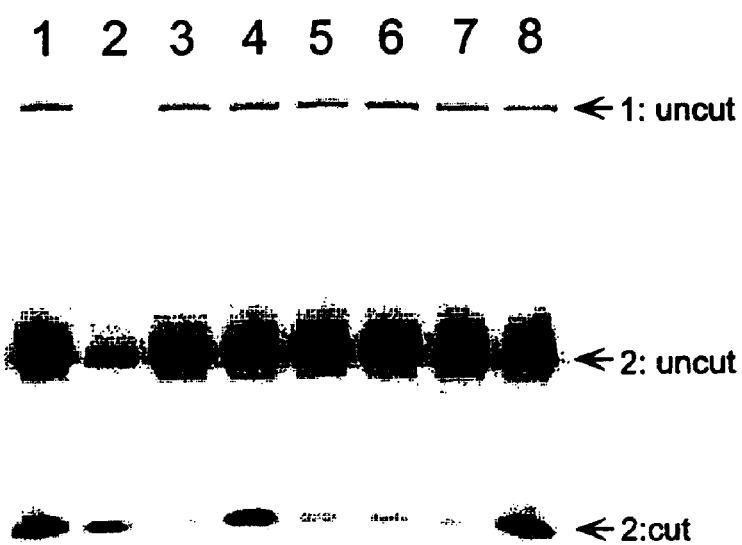
FIG. 29 shows the image generated by a fluorescence imager that shows that the products of a completed sequential invasive cleavage reaction cannot cross contaminant a subsequent similar reaction.

In FIG. 29, lane 1 shows the results of the first reaction with the accumulated product at the bottom of the panel, and lane 2 show a 1:10 dilution of the same reaction, to demonstrate the level of signal that could be expected from that level of contamination, without further amplification. Lanes 3 through 7 show the results of the secondary cleavage reactions that contained 0, 10, 1, 0.1 or 0.01% of the first reaction material added as contaminant, respectively and lane 8 shows a control reaction that had 100 amol of target DNA added to verify the activity of the system in the secondary reaction. The signal level in lane 4 is as would be expected when 10% of the pre-cleaved material is transferred (as in lane 2) and 10% of the transferred target material from the lane 1 reaction is allowed to further amplify. At all levels of further dilution the signal is not readily distinguished from background. These data demonstrate that while a large-scale transfer from one reaction to another may be detectable, cross contamination by the minute quantities that would be expected from aerosol or from equipment contamination would not be easily mistaken for a false positive result. These data also demonstrate that when the products of one reaction are deliberately carried over into a fresh sample, these products do not participate in the new reaction, and thus do not affect the level of target-dependent signal that may be generated in that reaction.

Example 13

Detection of Human Cytomegalovirus Viral DNA by Invasive Cleavage

Figure 30:
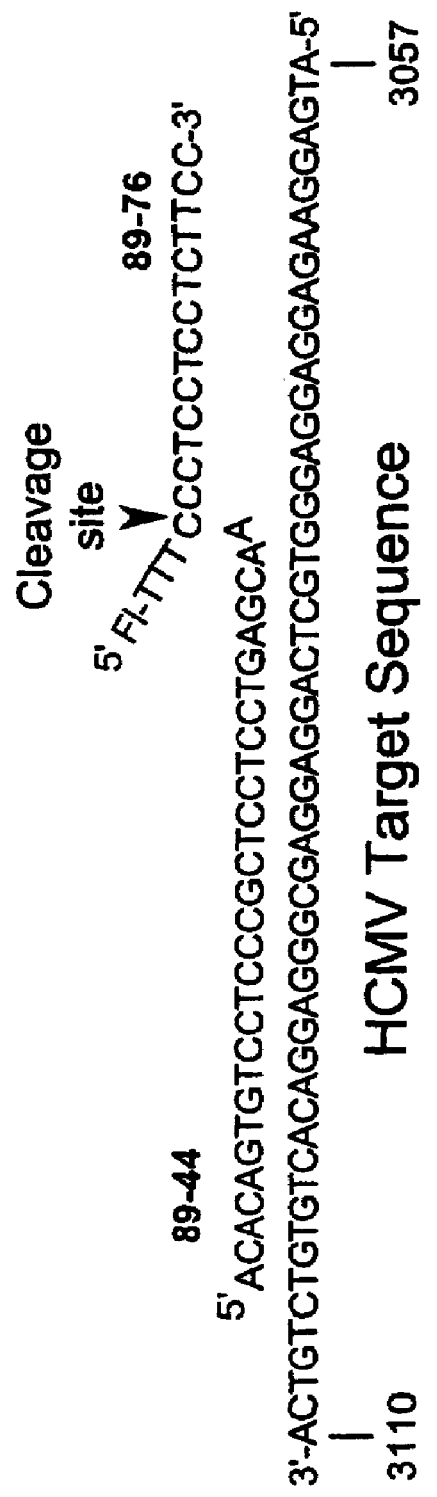
FIG. 30 shows the sequence of the oligonucleotide employed in an invasive cleavage reaction for the detection of HCMV viral DNA.

The previous Example demonstrates the ability of the invasive cleavage reaction to detect minute quantities of viral DNA in the presence of human genomic DNA. In this Example, the probe and INVADER oligonucleotides were designed to target the 3104–3061 region of the major immediate early gene of human cytomegalovirus (HCMV) as shown in FIG. 30. In FIG. 30, the INVADER oligo (89-44; SEQ ID NO:219) and the fluorescein (Fl)-labeled probe oligo (89-76; SEQ ID NO:218) are shown annealed along a region of the HCMV genome corresponding to nucleotides 3057–3110 of the viral DNA (SEQ ID NO:220). The probe used in this Example is a poly-pyrimidine probe and as shown herein the use of a poly-pyrimidine probe reduces background signal generated by the thermal breakage of probe oligos.

The genomic viral DNA was purchased from Advanced Biotechnologies, Incorporated (Columbia, Md.). The DNA was estimated (but not certified) by personnel at Advanced Biotechnologies to be at a concentration of 170 amol ($1 \times 10^8$ copies) per microliter. The reactions were performed in quadruplicate. Each reaction comprised 1 µM 5' fluorescein labeled probe oligonucleotide 89-76 (SEQ ID NO:218), 100 nM INVADER oligonucleotide 89-44 (SEQ ID NO:219), 1 ng/ml human genomic DNA, and one of five concentrations of target HCMV DNA in the amounts indicated above each lane in FIG. 31, and 10 ng of Pfu FEN-1 in 10 µl of 10 mM MOPS (pH 7.5), 6 mM $MgCl_2$ with 0.05% each of Tween 20 and Nonidet P-40. All of the components except the labeled probe, enzyme and $MgCl_2$ were assembled in a final volume of 7 µl and were overlaid with 10 µl of CHILLOUT liquid wax. The samples were heated to 95° C. for 5 min, then reduced to 62° C. The reactions were started by the addition of probe, Pfu FEN-1 and $MgCl_2$, in a 3 µl volume. After incubation at 62° C. for 60 minutes, the reactions were stopped with 10 µl of 95% formamide, 10 mM EDTA, 0.02% methyl violet. Samples were heated to 90° C. for 1 min immediately before electrophoresis through a 20% acrylamide gel (19:1 cross-linked), with 7 M urea, in a buffer of 45 mM Tris-Borate, pH 8.3, 1.4 mM EDTA. Gels were then analyzed with a Molecular Dynamics FluorImager 595.

Figure 31:
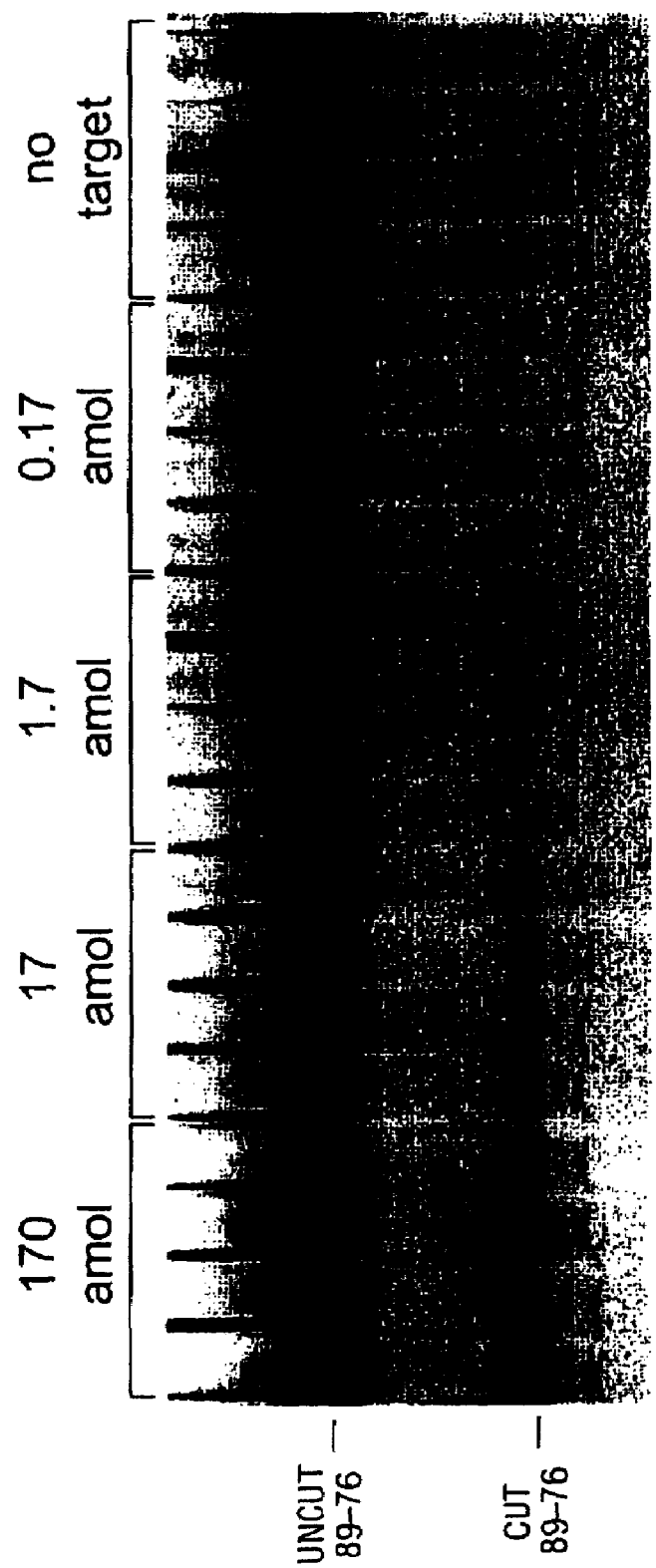
FIG. 31 shows the image generated by a fluorescence imager that shows the sensitive detection of HCMV viral DNA in samples containing human genomic DNA using an invasive cleavage reaction.

The resulting image is displayed in FIG. 31. The replicate reactions were run in groups of four lanes with the target HCMV DNA content of the reactions indicated above each set of lanes (0–170 amol). The uncleaved probe is seen in the upper third of the panel ("Uncut 89-76") while the cleavage products are seen in the lower two-thirds of the panel ("Cut 89-76"). It can be seen that the intensity of the accumulated cleavage product is proportional to the amount of the target DNA in the reaction. Furthermore, it can be clearly seen in reactions that did not contain target DNA ("no target") that the probe is not cleaved, even in a background of human genomic DNA. While 10 ng of human genomic DNA was included in each of the reactions shown in FIG. 31, inclusion of genomic DNA up to 200 ng has slight impact on the amount of product accumulated. The data did not suggest that 200 ng per 10 µl of reaction mixture represented the maximum amount of genomic DNA that could be tolerated without a significant reduction in signal accumulation. For reference, this amount of DNA exceeds what might be found in 0.2 ml of urine (a commonly tested amount for HCMV in neonates) and is equivalent to the amount that would be found in about 5 µl of whole blood.

These results demonstrate that the standard (i.e., non-sequential) invasive cleavage reaction is a sensitive, specific and reproducible means of detecting viral DNA. Detection of 1.7 amol of target is roughly equivalent to detection of $10^6$ copies of the virus. This is equivalent to the number of viral genomes that might be found in 0.2 mls of urine from a congenitally infected neonate ($10^2$ to $10^6$ genome equivalents per 0.2 mls; Stagno et al., J. Infect. Dis., 132:568 [1975]). Use of the sequential invasive cleavage assay would permit detection of even fewer viral DNA molecules, facilitating detection in blood ($10^1$ to $10^5$ viral particles per ml; Pector et al., J. Clin. Microbiol., 30:2359 [1992]), which carries a much larger amount of heterologous DNA.

From the above it is clear that the invention provides reagents and methods to permit the detection and characterization of nucleic acid sequences and variations in nucleic acid sequences. The INVADER-directed cleavage reaction and the sequential INVADER-directed cleavage reaction of the present invention provide ideal direct detection methods that combine the advantages of the direct detection assays (e.g., easy quantification and minimal risk of carry-over contamination) with the specificity provided by a dual or tri oligonucleotide hybridization assay.

Figure 32:
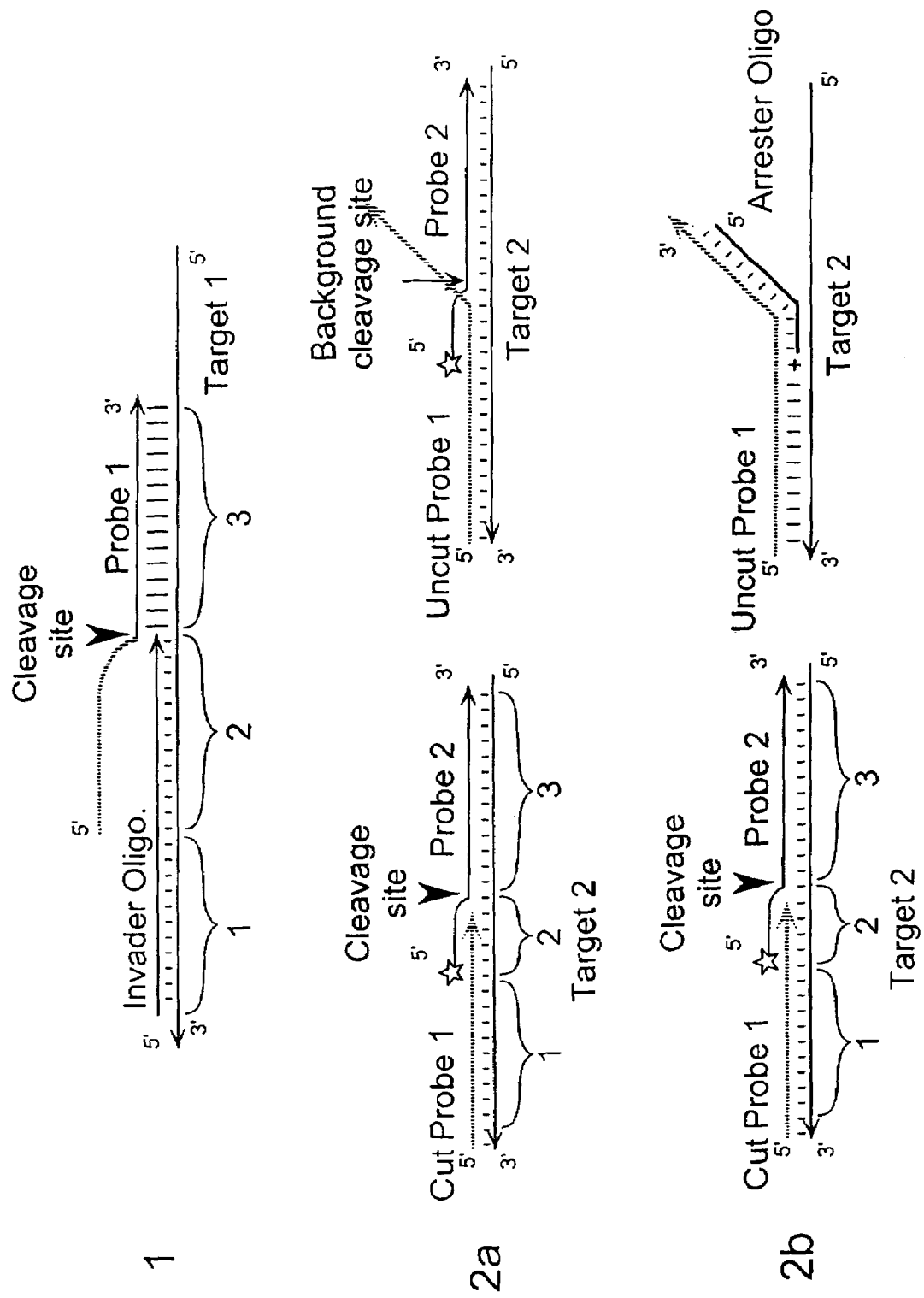
FIG. 32 is a schematic that illustrates one embodiment of the present invention, where the cut probe from an initial invasive cleavage reaction is employed as the INVADERoligonucleotide in a second invasive cleavage reaction, and where an ARRESTOR oligonucleotide prevents participation of remaining uncut first probe in the cleavage of the second probe.
Figure 33:
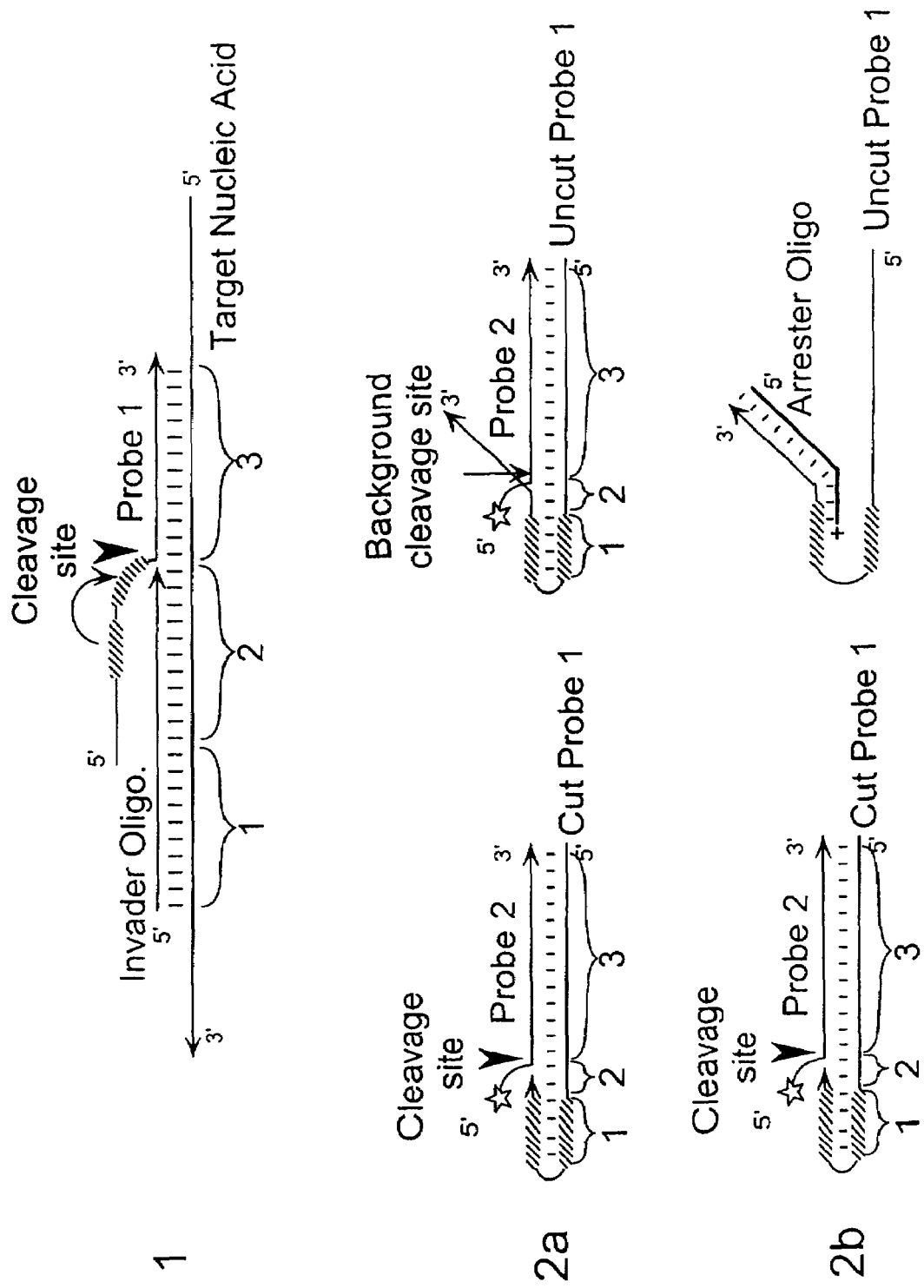
FIG. 33 is a schematic that illustrates one embodiment of the present invention, where the cut probe from an initial invasive cleavage reaction is employed as an integrated INVADER-target complex in a second invasive cleavage reaction, and where an ARRESTOR oligonucleotide prevents participation of remaining uncut first probe in the cleavage of the second probe.

As indicated in the Description of the Invention, the use of sequential invasive cleavage reactions can present the problem of residual uncut first, or primary, probe interacting with the secondary target, and either competing with the cut probe for binding, or creating background through low level cleavage of the resulting structure. This is shown diagramatically in FIGS. 32 and 33. In FIG. 32, the reaction depicted makes use of the cleavage product from the first cleavage structure to form an INVADER oligonucleotide for a second cleavage reaction. The structure formed between the secondary target, the secondary probe and the uncut primary probe is depicted in FIG. 32, as the right hand structure shown in step 2a. This structure is recognized and cleaved by the 5' nucleases, albeit very inefficiently (i.e., at less than about 1% in most reaction conditions). Nonetheless, the resulting product is indistinguishable from the specific product, and thus may lead to a false positive result. The same effect can occur when the cleaved primary probe creates and integrated INVADER/target (IT) molecule, as described in Example 11; the formation of the undesirable complex is depicted schematically in FIG. 33, as the right hand structure shown in step 2a.

The improvements provided by the inclusion of ARRESTOR oligonucleotides of various compositions in each of these types of sequential INVADER assays are demonstrated in the following Examples. These ARRESTOR oligonucleotides are configured to bind the residual uncut probe from the first cleavage reaction in the series, thereby increasing the efficacy of and reducing the non-specific background in the subsequent reaction(s).

Example 14

"ARRESTOR" Oligonucleotides Improve Sensitivity of Multiple Sequential Invasive Cleavage Assays In this Example, the effect of including an ARRESTOR oligonucleotide on the generation of signal using the IT probe system 33 is demonstrated. The ARRESTOR oligonucleotide hybridizes to the primary probe, mainly in the portion that recognizes the target nucleic acid during the first cleavage reaction. In addition to examining the effects of adding an ARRESTOR oligonucleotide, the effects of using ARRESTOR oligonucleotides that extended in complementarity different distances into the region of the primary probe that composes the secondary IT structure were also investigated. These effects were compared in reactions that included the target DNA over a range of concentrations, or that lacked target DNA, in order to demonstrate the level of nonspecific (i.e., not related to target nucleic acid) background in each set of reaction conditions.

The target DNA for these reactions was a fragment that comprised the full length of the hepatitis B genome from strain of serotype adw. This material was created using the polymerase chain reaction from plasmid pAM6 (ATCC #45020D). The PCRs were conducted using a vector-based forward primer, oligo # 156-022-001 (5'-ggcgaccacacccgtc-ctgt-3'; SEQ ID NO:594) and a reverse primer, oligo #156-022-02 (5'-ccacgatgcgtccggcgtag-3'; SEQ ID NO:595) to amplify the full length of the HBV insert, an amplicon of about 3.2 kb. The cycling conditions included a denaturation of the plasmid at 95° C. for 5 minutes, followed by 30 cycles of 95° C., 30 seconds; 60° C., 40 seconds; and 72° C., 4 minutes. This was followed by a final extension at 72° C. for 10 minutes. The resulting amplicon, termed pAM6#2, was adjusted to 2 M NH$_4$OAc, and collected by precipitation wiht isopropanol. After drying in vacuo, DNA was dissolved in 10 mM Tris pH 0.0, 0.1 mM EDTA. The concentration was determined by OD$_{200}$ measurement, and by INVADER assay with comparison to a standard of known concentration.

The INVADER reactions were conducted as follows. Five master mixes, termed "A," "B," "C," "D," and "E," were assembled; all mixes contained 12.5 mM MOPS, pH 7.5, 500 fmoles primary INVADER oligo #218-55-05 (SEQ ID NO:596), 10 ng human genomic DNA (Novagen) and 30 ng AfuFEN1 enzyme, for every 8 µl of mix. Mix A contained no added HBV genomic amplicon DNA; mix B contained 600 molecules of HBV genomic amplicon DNA pAM6 #2; mix C contained 6,000 molecules pAM6 #2; mix D contained 60,000 molecules pAM6 #2; and mix E contained 600,000 molecules pAM6 #2. The mixes were aliquotted to the reaction tubes, 8 µl/tube: mix A to tubes 1, 2, 11, 12, 21 and 22; mix B to tubes 3, 4, 13, 14, 23 and 24; mix C to tubes 5, 6, 15, 16, 25 and 26; mix D to tubes 7, 8, 17, 18, 27 and 28; and mix E to tubes 9, 10, 19, 20, 29 and 30. The samples were incubated at 95° C. for 4 minutes to denature the HBV genomic amplicon DNA. The reactions were then cooled to 67° C., and 2 µl of a mix containing 37.5 mM $MgCl_2$ and 2.5 pmoles 218-95-06 (SEQ ID NO:597) for every 2 µl, was added to each sample. The samples were incubated at 67° C. for 60 minutes. Three secondary reaction master mixes were prepared, all mixes contained 10 pmoles of secondary probe oligonucleotide #228-48-04 (SEQ ID NO:598) for every 2 µl of mix. Mix 2A contained no additional oligonucleotide, mix 2B contained 5 pmoles "ARRESTOR" oligo # 218-95-03 (SEQ ID NO:599) and mix 2C contained 5 pmoles of "ARRESTOR" oligo # 218-95-01 (SEQ ID NO:600). After the 60 minute incubation at 67° C. (the primary reaction described above), 2 µl of the secondary reaction mix was added to each sample: Mix 2A was added to samples #1–10; Mix 2B was added to samples #11–20; and Mix 2C was added to samples #21–30. The temperature was adjusted to 52° C. and the samples were incubated for 30 minutes at 52° C. The reactions were then stopped by the addition of 10 µl of a solution of 95% formamide, 5 mM EDTA and 0.02% crystal violet. All samples were heated to 95° C. for 2 minutes, and 4 µl of each sample were resolved by electrophoresis through 20% denaturing acrylamide gel (19:1 cross-linked) with 7 M urea, in a buffer containing 45 mM Tris-Borate (pH8.3) and 1.4 mM EDTA. The results were imaged using the Molecular Dynamics Fluoroimager 595, excitation 488, emission 530. The resulting images are shown in FIG. 34.

Figure 34:
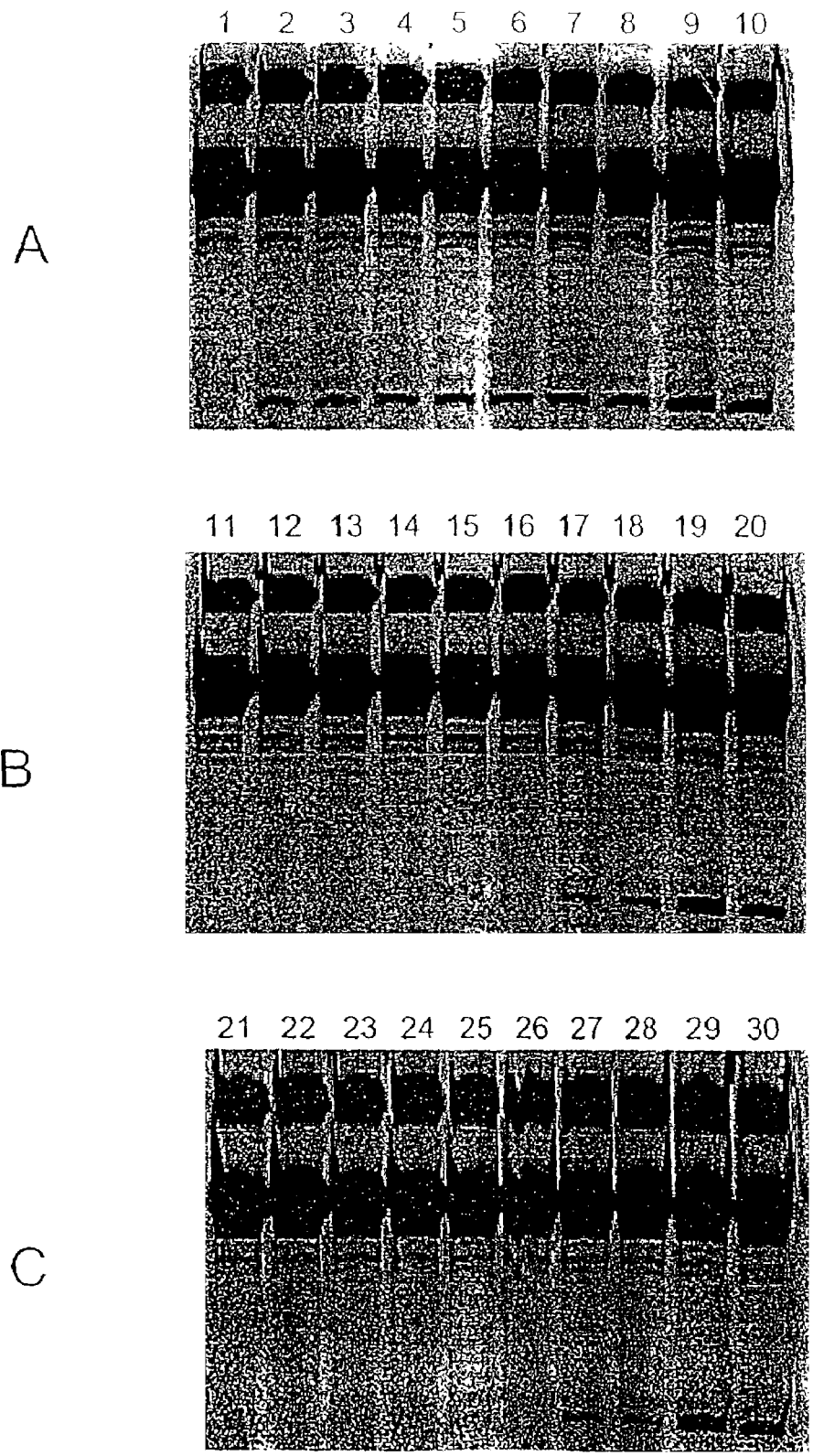
FIG. 34 shows three images generated by a fluorescence imager showing that two different lengths of 2' O-methyl, 3' terminal amine-modified ARRESTOR oligonucleotide both reduce non-specific background cleavage of the secondary probe when included in the second step of a reaction where the cut probe from an initial invasive cleavage reaction is employed as an integrated INVADER-target complex in a second invasive cleavage reaction.

In FIG. 34, Panel A shows the results of the target titration when no ARRESTOR oligonucleotide was included in the secondary reaction; Panel B shows the results of the same target titration using an ARRESTOR oligonucleotide that extended 2 nt into the non-target complementary region of the primary probe; and Panel C shows the results of the same target titration using an ARRESTOR oligonucleotide that extended 4 nt into the non-target complementary region of the primary probe. The product of the secondary cleavage reaction is seen as a band near the bottom of each panel. The first two lanes of each panel (i.e., 1 and 2, 11 and 12, 21 and 22) lacked target DNA, and the signal that co-migrates with the product band represents the nonspecific background under each set of conditions.

It can be seen by visual inspection of these panels that the background signal is both reduced, and made more predictable, by the inclusion of either species of ARRESTOR oligonucleotide. In addition to reducing the background in the no-target control lanes, the background reduction in the reactions that had the more dilute amounts of target included is reduced, leading to a signal that is a more accurate reflection of the target contained within the reaction, thus improving the quantitative range of the multiple, sequential invasive cleavage reaction.

To quantify the impact of including the ARRESTOR oligonucleotide in the secondary cleavage reaction under these conditions, the average product band signal from the reactions having the largest amount of target (i.e., averages of the signals from lanes 9 and 10, lanes 19 and 20, and lanes 29 and 30), were compared to the averaged signal from the no-target contol lanes for each panel, determine the "fold over background," the factor of signal amplification over background, under each set of conditions. For the reactions without the ARRESTOR oligonucleotide, Panel A, the fold over background was 5.3; for Panel B, the fold over background was 12.7; and for Panel C, the fold over background was 13.4, indicating that in this system inclusion of any ARRESTOR oligonucleotide at least doubled the specificity of the signal over the ARRESTOR oligonucleotide-less reactions, and that the ARRESTOR oligonucleotide that extended slightly farther into the non-target complementary region may be slightly more effective, at least in this embodiment of the system. This clearly shows the benefits of using an ARRESTOR oligonucleotide to enhance the specificity of these reactions, an advantage that is of particular benefit at low levels of target nucleic acid.

Example 15

"ARRESTOR" Oligonucleotides Allow use of Higher Concentrations of Primary Probe Without Increasing Background Signal Increasing the concentration of the probe in the invasive cleavage reaction can dramatically increase the amount of signal generated for a given amount of target DNA. While not intending to limit the explanation to any specific mechanism, this is believed to be caused by the fact that increased concentration of probe increases the rate at which the cleaved probe is supplanted by an uncleaved copy, thereby increasing the apparent turnover rate of the cleavage reaction. Unfortunately, this effect could not heretofore be applied in the primary cleavage reaction of a multiple sequential INVADER assay because the residual uncleaved primary probe can hybridize to the secondary target, in competition with the cleaved molecules, thereby reducing the efficacy of the secondary reaction. Elevated concentrations of primary probe exacerbate this problem. Further, the resulting complexes, as described above, can be cleaved at a low level, contributing to background. Therefore, increasing the primary probe can have the double negative effect of both slowing the secondary reaction and increasing the level of this form of non target-specific background. The use of an ARRESTOR oligonucleotide to sequester or neutralize the residual primary probe allows this concentration-enhancing effect to be applied to these sequential reactions.

To demonstrate this effect, two sets of reactions were conducted. In the first set of reactions, the reactions were conducted using a range of primary probe concentrations, but no ARRESTOR oligonucleotide was supplied in the secondary reaction. In the second set of reactions, the same probe concentrations were used, but an ARRESTOR oligonucleotide was added for the secondary reactions.

Figure 35A:
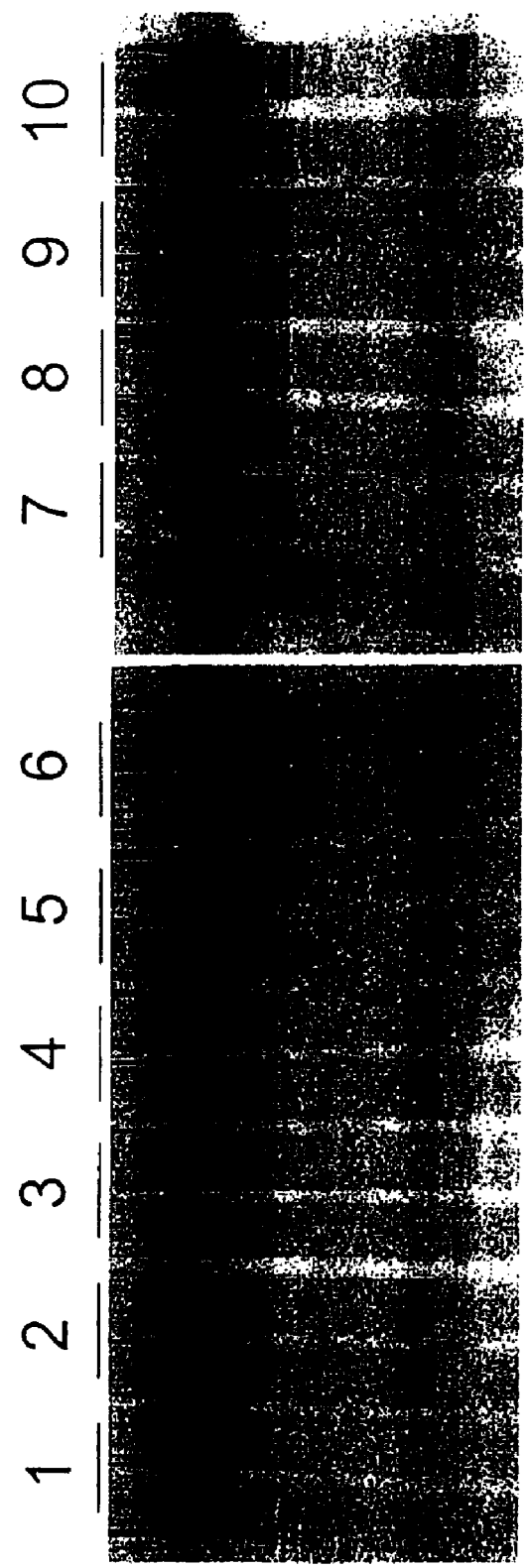
FIG. 35A shows two images generated by a fluorescence imager showing the effects on nonspecific and specific cleavage signal of increasing concentrations of primary probe in the first step of a reaction where the cut probe from an initial invasive cleavage reaction is employed as the INVADER oligonucleotide in a second invasive cleavage reaction.
Figure 35B:
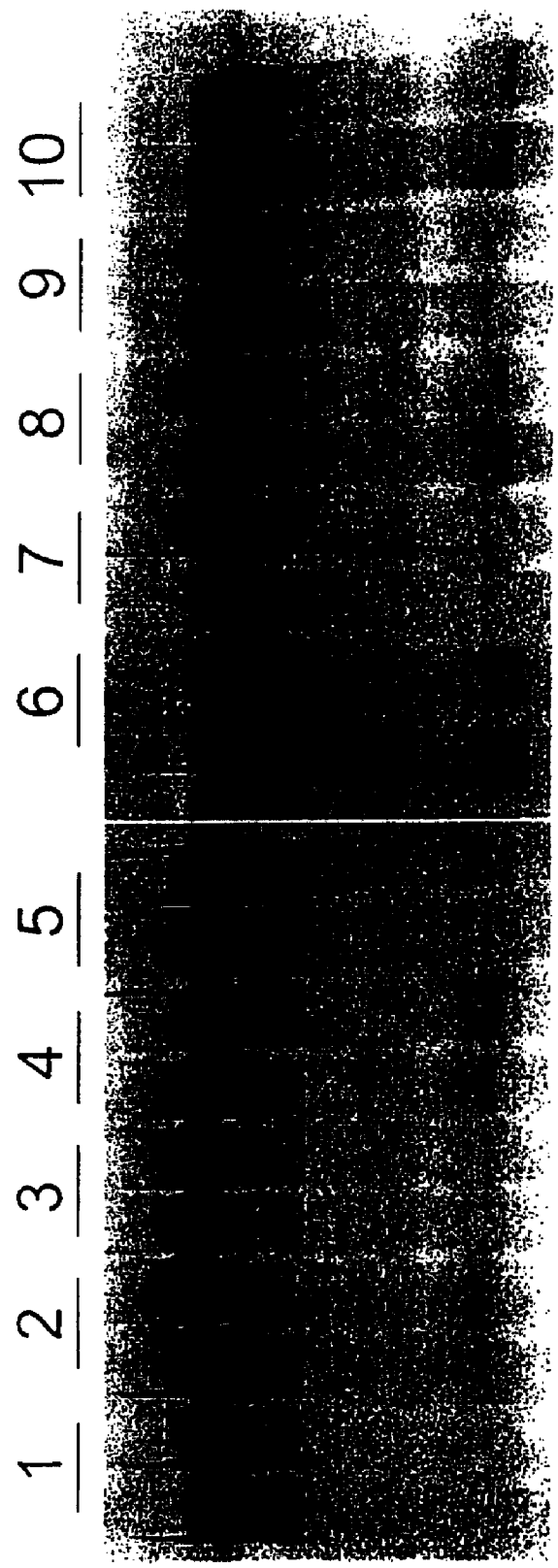
FIG. 35B shows two images generated by a fluorescence imager showing the effects on nonspecific and specific cleavage signal of increasing concentrations of primary probe in the first step of a reaction, and inclusion of a 2' O-methyl, 3' terminal amine-modified ARRESTOR oligonucleotide in the second step of a reaction where the cut probe from an initial invasive cleavage reaction is employed as the INVADER oligonucleotide in a second invasive cleavage reaction.

All reactions were performed in duplicate. Primary INVADER reactions were done in a final volume of 10 µl and contained: 10 mM MOPS, pH 7.5, 7.5 mM $MgCl_2$, 500 fin of primary INVADER (218-55-05; SEQ ID NO:596); 30 ng of AfuFEN1 enzyme and 10 ng of human genomic DNA. 100 zeptomoles of HBV pAM6 #2 amplicon was included in all even numbered reactions (by reference to FIGS. 35A and B). Reactions included 10 pmoles, 20 pmoles, 50 pmoles, 100 pmoles or 150 pmoles of primary probe (218-55-02; SEQ ID NO:601). MOPS, target and INVADER oligonucleotides were combined to a final volume of 7 µl. Samples were heat denatured at 95° C. for 5 minutes, then cooled to 67° C. During the 5 minute denaturation, $MgCl_2$, probe and enzyme were combined. The primary INVADER reactions were initiated by the addition of 3 µl of $MgCl_2$, probe and enzyme mix, to the final concentrations indicated above. Reactions were incubated for 30 minutes at 67° C. The reactions were then cooled to 52° C., and each primary INVADER reaction received the following secondary reaction components in a total volume of 4 µl: 2.5 pmoles secondary target (oligo number 218-95-04; SEQ ID NO:602); 10 pmoles secondary probe (oligo number 228-48-04; SEQ ID NO:598). The reactions that included the ARRESTOR oligonucleotide had either 40 pmoles, 80 pmoles, 200 pmoles, 400 pmoles or 600 pmoles of ARRES- TOR oligonucleotide (oligo number 218-95-01; SEQ ID NO:600), added at a 4-fold molar excess over the primary probe amount for each reaction, with this mix. Reactions were then incubated at 52° C. for 30 minutes. The reactions were stopped by the addition of 10 µl of a solution of 95% formamide, 10 mM EDTA and 0.02% crystal violet. All samples were heated to 95° C. for 1 minute, and 4 µl of each sample were resolved by electrophoresis through 20% denaturing acrylamide gel (19:1 cross-linked) with 7 M urea, in a buffer containing 45 mM Tris-Borate (pH8.3) and 1.4 mM EDTA. The results were imaged using the Molecular Dynamics Fluoroimager 595, excitation 488, emission 530. The resulting images for the reactions either without or with an ARRESTOR oligonucleotide are shown in FIGS. 35A and 35B, respectively. The products of cleavage of the secondary probe are seen as a band near the bottom of each panel.

In FIG. 35A, lane sets 1 and 2 show results with 10 pmoles of primary probe; 3 and 4 had 20 pmoles; 5 and 6 had 50 pmoles; 7 and 8 had 100 pmoles; and 9 and 10 had 150 pmoles. It can be seen by visual examination, that the increases in the amount of primary probe have the combined effect of slightly increasing the background in the no-target lanes (odd numbers) while reducing the specific signal in the presence of target (even numbered lanes), and therefore the reducing the specificity of the reaction if viewed as the measure of "fold over background," demonstrating that the approach of increasing signal by increasing probe cannot be applied in these sequential reactions.

In FIG. 35B, lane sets 1 and 2 show results with 10 pmoles of primary probe; while 3 and 4 had 20 pmoles; 5 and 6 had 50 pmoles; 7 and 8 had 100 pmoles; and 9 and 10 had 150 pmoles. In addition, each reaction included 4-fold molar excess of the ARRESTOR oligonucleotide added before the secondary cleavage reaction. It can be seen by visual examination that the background in the no-target lanes (odd numbers) is lower in all cases, while the specific signal in the presence of target (even numbered lanes) increases with increased amounts of primary probe, leading to a greater "fold over background" sensitivity at this target level.

Figure 35C:
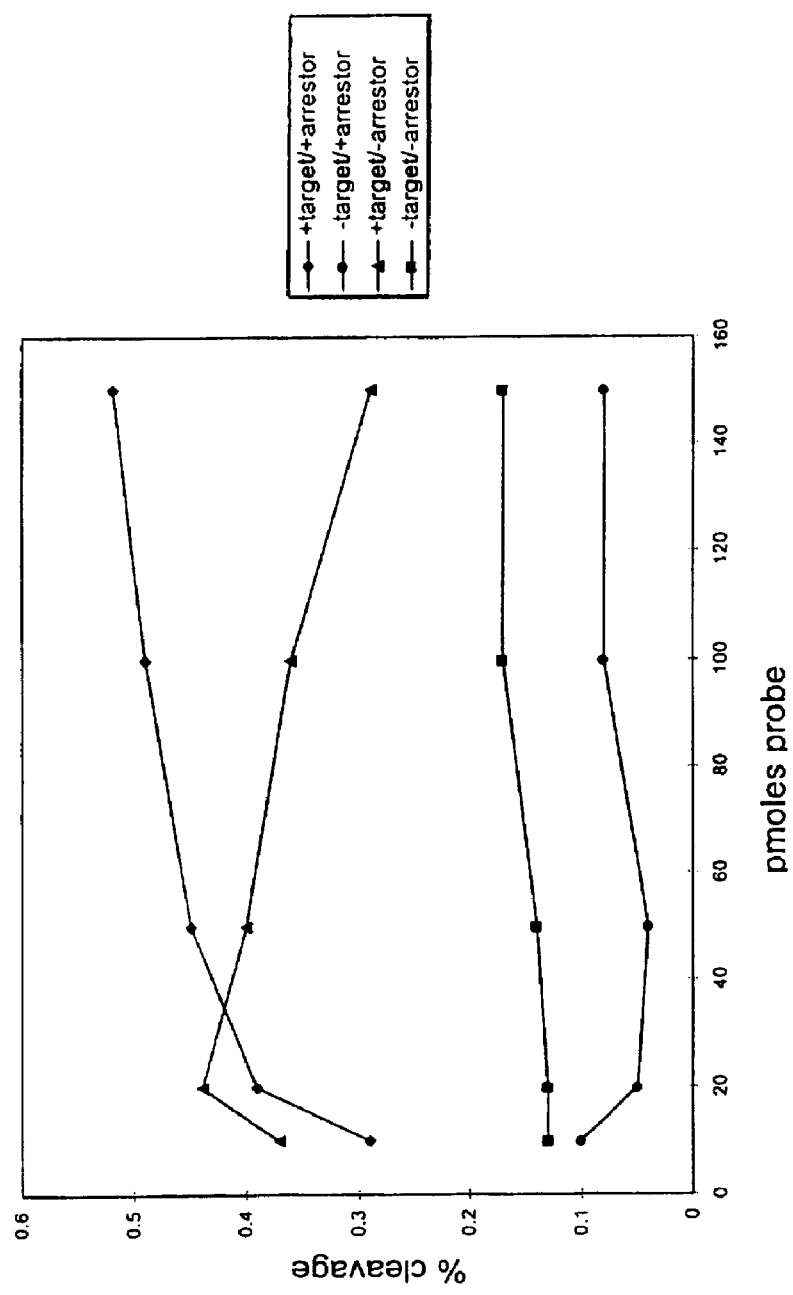
FIG. 35C shows shows a graph generated using the spreadsheet MICROSOFT EXCEL software, comparing the effects on nonspecific and specific cleavage signal of increasing concentrations of primary probe in the first step of a reaction, in the presence or absence of a 2' O-methyl, 3' terminal amine-modified ARRESTOR oligonucleotide in the second step of a reaction where the cut probe from an initial invasive cleavage reaction is employed as the INVADER oligonucleotide in a second invasive cleavage reaction.

To quantitatively compare these effects, the fluorescence signal from the products of both non-specific and specific cleavage were measured. The results are depicted graphically in FIG. 35C, graphed as a measure of the percentage of the secondary probe cleaved during the reaction, compared to the amount of primary probe used. Examination of the plots from the no-target reactions confirms that the background in the absence of the ARRESTOR oligonucleotide is, in general, roughly two-fold higher, and that both increase slightly with the increasing probe amounts. The specific signals however, diverge between the two sets of reaction more dramatically. While the signal in the no-ARRESTOR oligonucleotide reactions decreases steadily as primary probe was increased, the signal in the ARRESTOR oligonucleotide reactions continued to increase. At the highest primary probe concentrations tested, the no-ARRESTOR oligonucleotide reactions had specific signal that was only 1.7 fold over background, while the ARRESTOR oligonucleotide reactions detected the 100 zmoles (60,000 copies) of target with a signal 6.5 fold over background, thus demonstrating the improvement in the sequential invasive cleavage reaction when an ARRESTOR oligonucleotide is included.

Example 16

Modified Backbones Improve Performance of ARRESTOR Oligonucleotides all Natural "ARRESTOR" Oligo with No 3'-Amine The reactions described in the previous two Examples used ARRESTOR oligonucleotides that were constructed using 2' O-methyl ribose backbone, and that included a positively charged amine group on the 3' terminal nucleotide. The modifications were made specifically to reduce enzyme interaction with the primary probe/ARRESTOR oligonucleotide complex. During the development of the present invention, it was determined that the 2' O-methy modified oligonucleotides are somewhat resistant to cleavage by the 5' nucleases, just as they are slowly degraded by nucleases when used in antisense applications (See e.g., Kawasaki et al., J. Med. Chem., 36:831 [1993]).

The presence of an amino group on the 3' end of an oligonucleotide reduces its ability to direct invasive cleavage. To reduce the possibility that the ARRESTOR oligonucleotide would form a cleavage structure in this way, an amino group was included in the design of the experiments described in this and other Examples.

Initial designs of the ARRESTOR oligonucleotides (sometimes referred to as "blockers") did not include these modifications, and these molecules were found to provide no benefit in reducing background cleavage in the sequential invasive cleavage assay and, in fact, sometimes contributed to background by inducing cleavage at an unanticipated site, presumably by providing some element to an alternative cleavage structure. The effects of natural and modified ARRESTOR oligonucleotides on the background noise in these reactions are examined in this Example.

The efficacy of an "all-natural ARRESTOR oligonucleotide (i.e., an ARRESTOR oligonucleotide that did not contain any base analogs or modifications) was examined by comparison to an identical reactions that lacked ARRESTOR oligonucleotide. All reactions were performed in duplicate, and were conducted as follows. Two master mixes were assembled, each containing 12.5 mM MOPS, pH 7.5, 500 fmoles primary INVADER oligonucleotide #218-55-05 (SEQ ID NO:596), 10 ng human genomic DNA (Novagen) and 30 ng AfuFEN1 enzyme for every 8 µl of mix. Mix A contained no added HBV genomic amplicon DNA, mix B contained 600,000 molecules of HBV genomic amplicon DNA, pAM6 #2. The mixes were distributed to the reaction tubes, in aliquots of 8 µl/tube as follows: mix A to tubes 1, 2, 5 and 6; and mix B to tubes 3, 4, 7 and 8. The samples were incubated at 95° C. for 4 minutes to denature the HBV genomic amplicon DNA. The reactions were then cooled to 67° C. and 2 ul of a mix containing 37.5 mM MgCl$_2$ and 10 pmoles 218-55-02B (SEQ ID NO:603) for every 2 µl, was added to each sample. The samples were then incubated at 67° C. for 30 minutes. Two secondary reaction master mixes were prepared, each containing 10 pmoles of secondary probe oligo #228-48-04N (SEQ ID NO:604) and 2.5 pmoles of secondary target oligonucleotide #218-95-04 (SEQ ID NO:602) for every 3 µl of mix. Mix 2A contained no additional oligonucleotide, while mix 2B contained 50 pmoles of the natural "ARRESTOR" oligonucleotide #241-62-02 (SEQ ID NO:605). After the initial 30 minute incubation at 67° C., the temperature was adjusted to 52° C., and 3 µl of a secondary reaction mix was added to each sample, as follows: Mix 2A was added to samples #1–4; and Mix 2B was added to samples #5–8. The samples were then incubated for 30 minutes at 52° C. The reactions were then stopped by the addition of 10 µl of a solution of 95% formamide, 10 mM EDTA and 0.02% crystal violet.

All of the samples were heated to 95° C. for 2 minutes, and 4 µl of each sample were resolved by electrophoresis through a 20% denaturing acrylamide gel (19:1 cross-linked) with 7 M urea, in a buffer containing 45 mM Tris-Borate (pH8.3) and 1.4 mM EDTA. The results were imaged using the Molecular Dynamics Fluoroimager 595, excitation 488, emission 530. The resulting image is shown in FIG. 36A.

To compare the effects of the various modifications made to the ARRESTOR oligonucleotides, reactions were performed using ARRESTOR oligonucleotides having all natural bases, but including a 3' terminal amine; ARRESTOR oligonucleotides having a 3' portion composed of 2' O-methyl nucleotides, plus the 3' terminal amine; and ARRESTOR oligonucleotides composed entirely of 2' O-methyl nucleotides, plus the 3' terminal amine. These were compared to reactions performed without an ARRESTOR oligonucleotide. The reactions were conducted as follows. Two master mixes were assembled, all mixes contained 14.3 mM MOPS, pH 7.5, 500 fmoles primary INVADER oligo #218-55-05 (SEQ ID NO:596) and 10 ng human genomic DNA (Novagen) for every 7 µl of mix. Mix A contained no added HBV genomic amplicon DNA, mix B contained 600,000 molecules of HBV genomic amplicon DNA, pAM6 #2. The mixes were distributed to the reaction tubes, at 7 µl/tube: mix A to tubes 1, 2, 5, 6, 9, 10, 13 and 14; and mix B to tubes 3, 4, 7, 8, 11, 12, 15 and 16. The samples were warmed to 95° C. for 4 minutes to denature the HBV DNA. The reactions were then cooled to 67° C. and 3 µl of a mix containing 25 mM $MgCl_2$, 25 pmoles 218-55-02B (SEQ ID NO:603) and 30 ng AfuFEN1 enzyme per 3 µl, were added to each sample. The samples were then incubated at 67° C. for 30 minutes. Four secondary reaction master mixes were prepared; all mixes contained 10 pmoles of secondary probe oligonucleotide #228-48-04B (SEQ ID NO:606) and 2.5 pmoles of secondary target oligonucleotide #218-95-04 (SEQ ID NO:602) for every 3 µl of mix. Mix 2A contained no additional oligonucleotide, while mix 2B contained 100 pmoles of the natural+amine ARRESTOR oligonucleotide # 241-62-01 (SEQ ID NO:607), mix 2C contained 100 pmoles of partially O-methyl+amine oligonucleotide # 241-62-03 (SEQ ID NO:608) and mix 2D contained 100 pmoles of all O-methyl+amine oligonucleotide # 241-64-01 (SEQ ID NO:609). After the initial 30 minute incubation at 67° C., the temperature was adjusted to 52° C. and 3 µl of a secondary reaction mix was added to each sample, as follows: mix 2A was added to samples #1–4; mix 2B was added to samples #5–8; mix 2C was added to samples #9–12; and mix 2D was added to samples #13–16. The samples were incubated for 30 minutes at 52° C., then stopped by the addition of 10 µl of a solution of 95% formamide, 10 mM NaEDTA, and 0.2% crystal violet.

All samples were heated to 95° C. for 2 minutes, and 4 µl of each sample were resolved by electrophoresis through a 20% denaturing acrylamide gel (19:1 cross-linked) with 7 M urea, in a buffer containing 45 mM Tris-Borate (pH8.3) and 1.4 mM EDTA. The results were imaged using the Molecular Dynamics Fluoroimager 595, excitation 488, emission 530. The resulting image is shown in FIG. 36B.

Figure 36A:
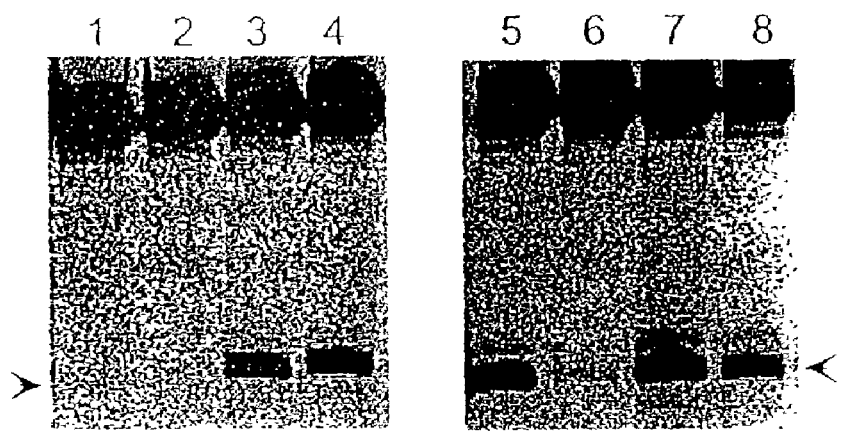
FIG. 36A shows two images generated by a fluorescence imager showing the effects on nonspecific and specific cleavage signal of including an unmodified ARRESTOR oligonucleotide in the second step of a reaction where the cut probe from an initial invasive cleavage reaction is employed as the INVADER oligonucleotide in a second invasive cleavage reaction.

In FIG. 36A, the left-hand panel shows the reactions that lacked an ARRESTOR oligonucleotide, while the right hand panel shows the data from reactions that included the all natural ARRESTOR oligonucleotide. The first two lanes of each panel are from no-target controls, the second set of lanes contained target. The products of cleavage are visible in the bottom one/fourth of each panel. The position at which the specific reaction products should run is indicated by arrows on left and right.

It can be seen by examination of these data, that the reactions run in the absence of ARRESTOR oligonucleotide show reproducible quality between the replicates, and show significant cleavage only when target is present. In contrast, the addition of another unmodified oligonucleotide into the reactions causes great variation between the replicate lanes (e.g., lanes 5 and 6 were provided with the same reactants, but produced markedly different results). The introduction of the all-natural ARRESTOR oligonucleotide produced, rather than reduced, background in these no-target lanes, and increased cleavage at other sites (i.e., the bands other that those indicated by the arrows flanking the panels). For these reasons the modifications that are described above, the effects of which are shown on FIG. 36B, were incorporated.

Figure 36B:
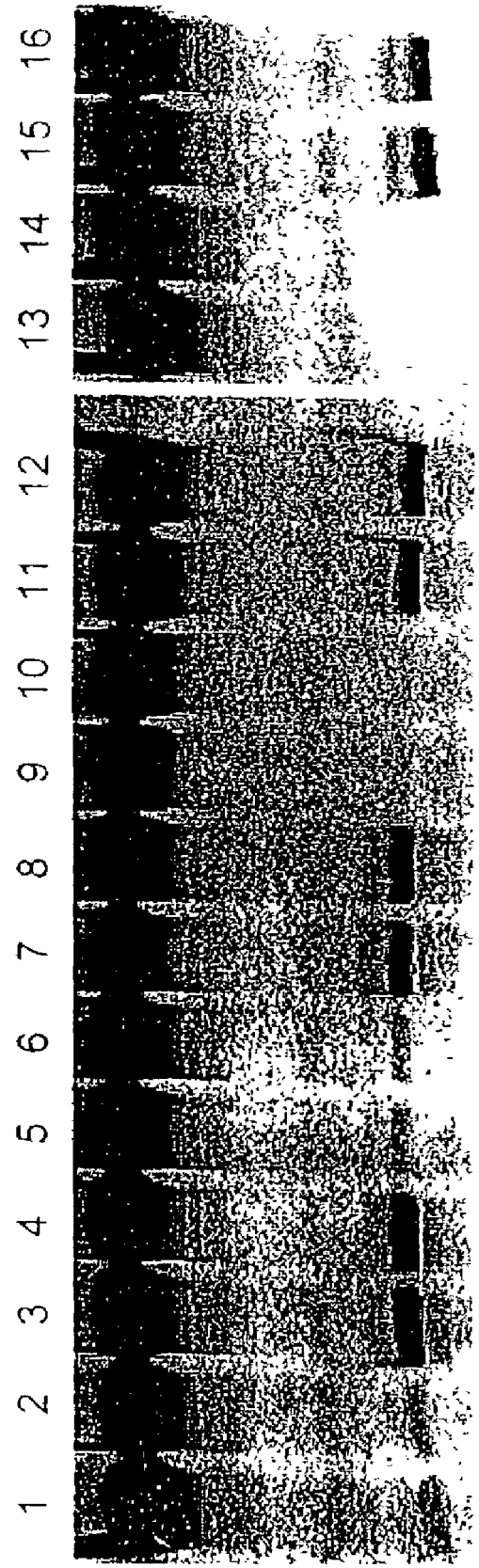
FIG. 36B shows two images generated by a fluorescence imager showing the effects on nonspecific and specific cleavage signal of including a 3' terminal amine modified ARRESTOR oligonucleotide, a partially 2' O-methyl substituted, 3' terminal amine modified ARRESTOR oligonucleotide, or an entirely 2' O-methyl, 3' terminal amine modified ARRESTOR oligonucleotide in the second step of a reaction where the cut probe from an initial invasive cleavage reaction is employed as the INVADER oligonucleotide in a second invasive cleavage reaction.

The first 4 lanes of FIG. 36B show the products of duplicate reactions without an ARRESTOR oligonucleotide, plus or minus the HBV target (lanes 1, 2, and lanes 3, 4, respectively); The next 4 lanes, 5, 6 and 7, 8 used a natural ARRESTOR oligonucleotide having a 3' terminal amine; lanes 9, 10 and 11, 12 used the ARRESTOR oligonucleotide with a 3' portion composed of 2' O-methyl nucleotides, and having a 3' terminal amine; lanes 13, 14 and 15, 16 used the ARRESTOR oligonucleotide composed entirely of 2' O-methyl nucleotides and having a 3' terminal amine. The products of cleavage of the secondary probe are visible in the lower one third of each panel.

Visual inspection of these data shows that the addition of the 3' terminal amine to the natural ARRESTOR oligonucleotide suppresses the aberrant cleavage seen in FIG. 36A, but this ARRESTOR oligonucleotide does not improve the performance of the reaction, as compared to the no-ARRESTOR oligonucleotide controls. In contrast, the use of the 2' O-methyl nucleotides in the body of the ARRESTOR oligonucleotide does reduce background, whether partially or completely substituted. To quantify the relative effects of these modifications, the fluorescence from each of the co-migrating product bands was measured, the signals from the duplicate lanes were averaged and the "fold over background" was calculated for each reaction containing target nucleic acid.

When ARRESTOR oligonucleotide was omitted, the target-specific signal (lanes 3, 4) was 27-fold over the no target background; the natural ARRESTOR oligonucleotide+ amine gave a signal of 17-fold over background; the partial 2' O-methyl+amine gave a signal of 47-fold over background; and the completely 2' O-methyl+amine gave a signal of 33 fold over background.

These Figures show that both modifications can have a beneficial effect on the specificity of the multiple, sequential invasive cleavage assay. They also show that the use of the 2' O-methyl substituted backbone, either partial or entire, markedly improves the specificity of these reactions. It is intended that, in various embodiments of the present invention, any number of modifications that make either the ARRESTOR oligonucleotide or the complex it forms with the primary target resistant to nucleases will provide similar enhancement.

Example 17

Effect of ARRESTOR Oligonucleotide Length on Signal Enhancement in Multiple Sequential Invasive Cleavage Assays As noted in the Description of the Invention, the optimal length for an ARRESTOR oligonucleotide depends upon the design of the other nucleic acid elements of the INVADER reaction, particularly on the design of the primary probe. In this Example, the effects of varying the length of the ARRESTOR oligonucleotide were explored in systems using two different secondary probes. A schematic diagram showing these ARRESTOR oligonucleotides aligned as they would hybridize to the primary probe oligonucleotide is provided in FIG. 37C. In this Figure, the region of the primary probe that recognizes the target nucleic acid is shown underlined; the non-underlined portion, plus the first underlined base is the portion that is released by the first cleavage, and goes on to participate in the second or subsequent cleavage structure.

All reactions were performed in duplicate. The INVADER reactions were done in a final volume of 10 µl final volume containing 10 mM MOPS, pH 7.5, mM MgCl$_2$, 500 fmoles of primary INVADER 241-95-01, (SEQ ID NO:610), 25 pmoles of primary probe 241-95-02 (SEQ ID NO:611), 30 ng of AfuFEN1 enzyme, and 10 ng of human genomic DNA, and if included, 1 amoles of HBV amplicon pAM 6 #2. MOPS, target DNA, and INVADER oligonucleotides were combined to a final volume of 7 µl. Samples were heat denatured at 95° C. for 5 minutes, then cooled to 67° C. During the 5 minute denaturation, MgCl$_2$, probe and enzyme were combined. The primary INVADER reactions were initiated by the addition of 3 µl of MgCl$_2$, probe and enzyme mix, to the final concentrations indicated above. Reactions were incubated for 30 minutes at 67° C. The reaction were then cooled to 52° C., and each primary INVADER reaction received the following secondary reaction components in a total volume of 3 µl: 2.5 pmoles secondary target 241-95-07 (SEQ ID NO:612), 10 pmoles of either secondary probe 228-48-04 (SEQ ID NO:598), or 228-48-04N (SEQ ID NO:604) and 100 pmoles of an ARRESTOR oligonucleotide, either 241-95-03 (SEQ ID NO:613), 241-95-04 (SEQ ID NO:614), 241-95-05 (SEQ ID NO:615) or 241-95-06 (SEQ ID NO:616). The ARRESTOR oligonucleotides were omitted from some reactions as controls for ARRESTOR oligonucleotide effects.

Figure 37A:
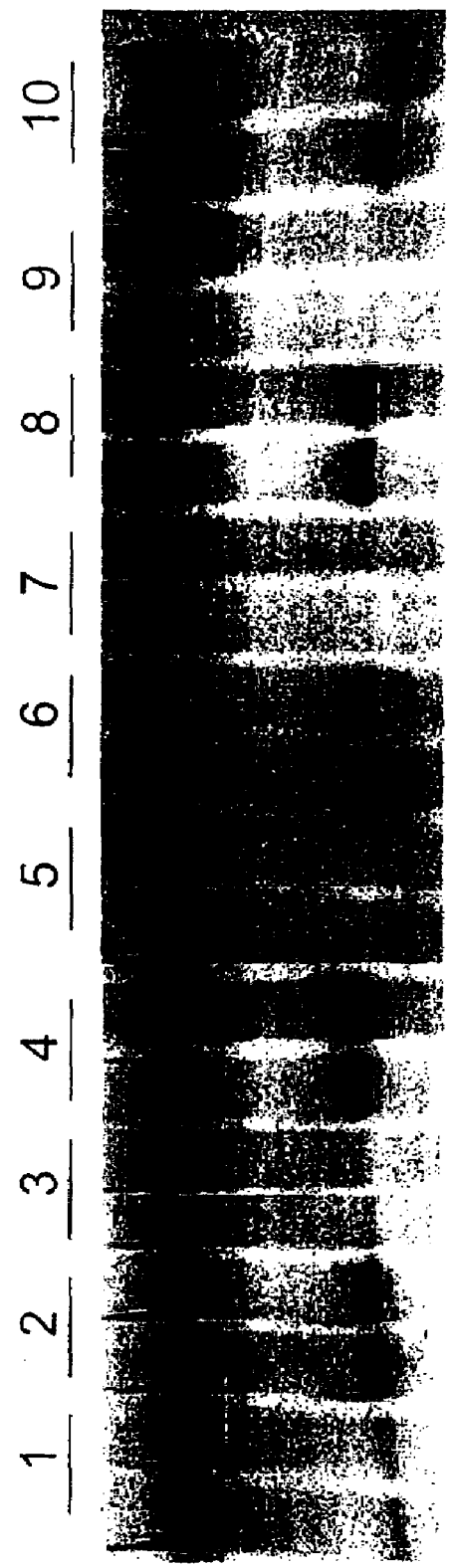
FIG. 37A shows two images generated by a fluorescence imager comparing the effects on nonspecific and specific cleavage signal of including ARRESTOR oligonucleotides of different lengths in the second step of a reaction where the cut probe from an initial invasive cleavage reaction is employed as the INVADER oligonucleotide in a second invasive cleavage reaction.
Figure 37B:
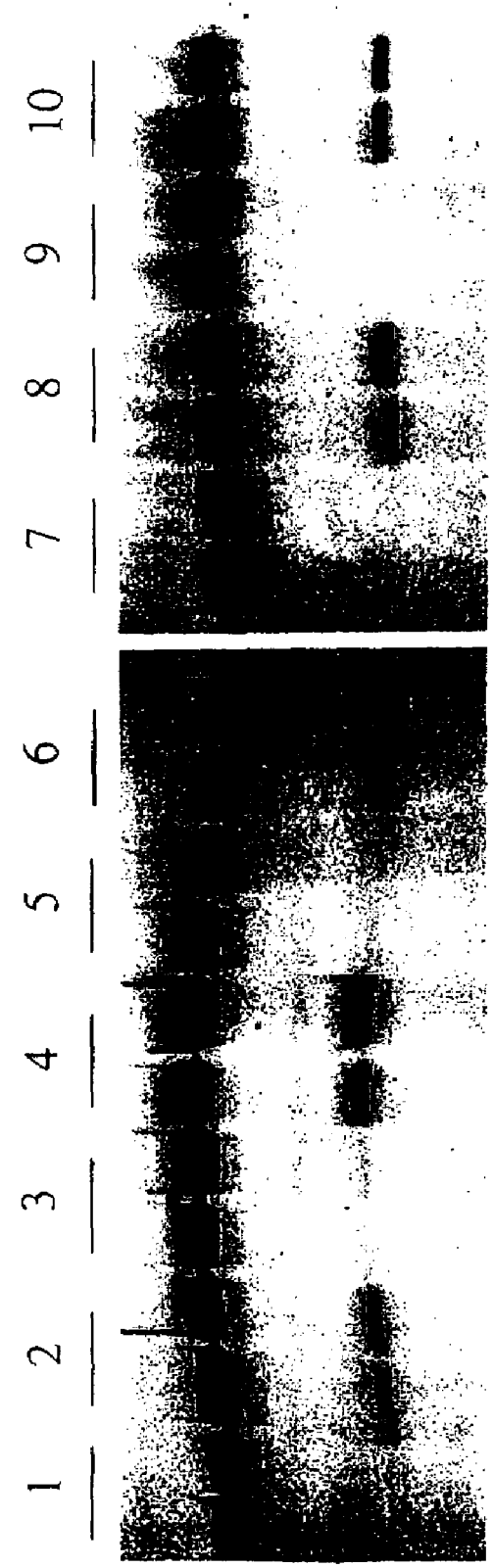
FIG. 37B shows two images generated by a fluorescence imager comparing the effects on nonspecific and specific cleavage signal of including an arrestoer oligonucleotides of different lengths in the second step of a reaction where the cut probe from an initial invasive cleavage reaction is employed as the INVADER oligonucleotide in a second invasive cleavage reaction, and in which a longer variant of the secondary probe used in the reactions in FIG. 37A is tested.
Figure 37C:
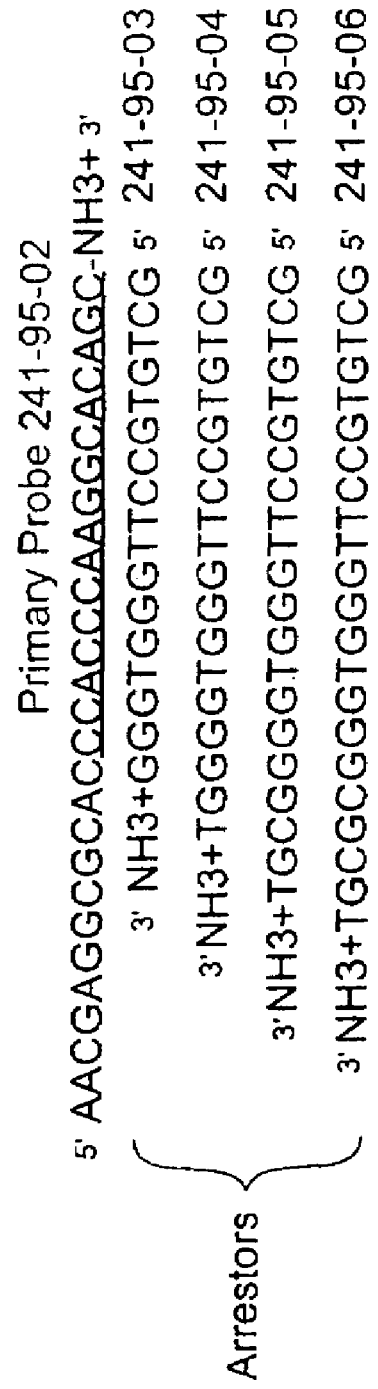
FIG. 37C shows a schematic diagram of a primary probe aligned with several ARRESTOR oligonucleotides of different lengths. The region of the primary probe that is complementary to the HBV target sequence is underlined. The ARRESTOR oligonucleotides are aligned with the probe by complementarity.

The reactions were incubated at 52° C. for 34 minutes, and were then stopped by the addition of 10 µl of 95% formamide, 10 mM EDTA, and 0.02% crystal violet. All samples were heated to 95° C. for 1 minute, and 4 µl of each sample were resolved by electrophoresis through 20% denaturing acrylamide gel (19:1 cross-linked) with 7 M urea, in a buffer containing 45 mM Tris-Borate (pH8.3) and 1.4 mM EDTA. The results were imaged using the Molecular Dynamics Fluoroimager 595, excitation 488, emission 530. The resulting images for the reactions with the shorter and longer secondary probes are shown in FIGS. 37A and 37B, respectively.

In each Figure, the products of cleavage are visible as bands in the bottom half of each lane. The first 4 lanes of each Figure show the products of duplicate reactions without an ARRESTOR oligonucleotide, plus or minus the HBV target (lanes sets 1 and 2 respectively); in the next 4 lanes, sets 3 and 4 used the shortest ARRESTOR 241-95-03 (SEQ ID NO:613); lanes 5 and 6 used 241-95-04 (SEQ ID NO:614); lanes 7 and 8 used 241-95-05 (SEQ ID NO:615); and lanes 9 and 10 used 241-95-06 (SEQ ID NO:616).

The principal background of concern is the band that appears in the "no target" control lanes (odd numbers; this band co-migrates with the target-specific signal near the bottom of each gel panel). Visual inspection shows that the shortest ARRESTOR oligonucleotide was the least effective at suppressing this background, and that the efficacy was increased when the ARRESTOR oligonucleotide extended further into the portion that participates in the subsequent cleavage reaction. Even with this difference in effect, it can be seen from these data that there is much latitude in the design of the ARRESTOR oligonucleotide. The choice of lengths will be influenced by the temperature at which the reaction making use of the ARRESTOR oligonucleotide is performed, the lengths of the duplexes formed between the primary probe and the target, the primary probe and the secondary target, and the relative concentrations of the different nucleic acid species in the reactions.

Example 18

Effect of ARRESTOR Oligonucleotide Concentration on Signal Enhancement in Multiple Sequential Invasive Cleavage Assays In examining the effects of including ARRESTOR oligonucleotides in these cleavage reactions, it was of interest to determine if the concentration of the ARRESTOR oligonucleotide in excess of the primary probe concentration would have an effect on yields of either non-specific or specific signal, and if the length of the ARRESTOR oligonucleotide would be a factor. These two variables were investigated in the following Example.

Figure 38:
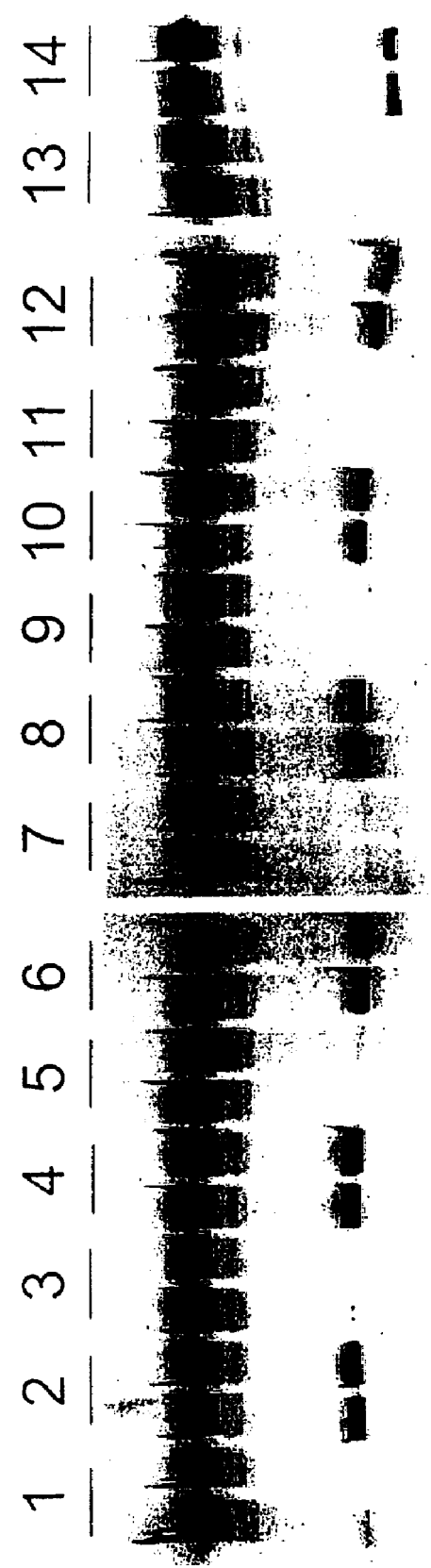
FIG. 38 shows two images generated by a fluorescence imager comparing the effects on nonspecific and specific cleavage signal of including ARRESTOR oligonucleotides of different lengths in the second step of a reaction where the cut probe from an initial invasive cleavage reaction is employed as the INVADER oligonucleotide in a second invasive cleavage reaction, using secondary probes of two different lengths.

All reactions were performed in duplicate. The primary INVADER reactions were done in a final volume of 10 µl and contained 10 mM MOPS, pH 7.5; 7.5 mM MgCl$_2$, 500 fmoles of primary INVADER 241-95-01 (SEQ ID NO:610), 25 pmoles of primary probe 241-95-02 (SEQ ID NO:611), 30 ng of AfuFEN1 enzyme, and 10 ng of human genomic DNA. Where included, the target DNA was 1 amole of HBV amplicon pAM 6 #2, as described above. MOPS, target and INVADER were combined to a final volume of 7 µl. The samples were heat denatured at 95° C. for 5 minutes, then cooled to 67° C. During the 5 minute denaturation, MgCl$_2$, probe and enzyme were combined. The primary INVADER reactions were initiated by the addition of 3 µl of MgCl$_2$, probe and enzyme mix. The reactions were incubated for 30 minutes at 67° C. The reactions were then cooled to 52° C. and each primary INVADER reaction received the following secondary reaction components: 2.5 pmoles secondary target 241-95-07 (SEQ ID NO:612), 10 pmoles secondary probe 228-48-04 (SEQ ID NO:598); and, if included, 50, 100 or 200 pmoles of either ARRESTOR oligonucleotide 241-95-03 (SEQ ID NO:613) or 241-95-05 (SEQ ID NO:615), in a total volume of 3 µl. Reactions were then incubated at 52° C. for 35 minutes. Reactions were stopped by the addition of 10 µl of 95% formamide, 10 mM EDTA, and 0.02% crystal violet. All of the samples were heated to 95° C. for 1 minute, and 4 µl of each sample were resolved by electrophoresis through 20% denaturing acrylamide gel (19:1 cross-linked) with 7 M urea, in a buffer containing 45 mM Tris-Borate (pH8.3), and 1.4 mM EDTA. The results were imaged using the Molecular Dynamics Fluoroimager 595, excitation 488, emission 530. The resulting images are shown as a composite image in FIG. 38.

Each of the duplicate reactions were loaded on the gel in adjacent lanes and are labeled with a single lane number. All odd numbered lanes were no-target controls. Lanes 1 and 2 had no ARRESTOR oligonucleotide added; lanes 3–8 show results from reactions containing the shorter ARRESTOR oligonucleotide, 241-95-03 (SEQ ID NO:613); lanes 9–14 show results from reactions containing the longer ARRESTOR oligonucleotide, 241-95-05 (SEQ ID NO:615). The products of cleavage from the secondary reaction are visible in the bottom one third of each panel. Visual inspection of these data (i.e., comparison of the specific products to the background bands) shows that both ARRESTOR oligonucleotides have some beneficial effect at all concentration.

To quantify the relative effects of ARRESTOR oligonucleotide length and concentration, the fluorescence from each of the co-migrating product bands was measured, the signals from the duplicate lanes were averaged and the "fold over background" (signal+target/signal-target) was calculated for each reaction containing target nucleic acid. The reaction lacking an ARRESTOR oligonucleotide yielded a signal approximately 27-fold over background. Inclusion of the shorter ARRESTOR oligonucleotide at 50, 100 or 200 pmoles produced products at 42, 51 and 60-fold over background, respectively. This shows that while the short ARRESTOR at the lowest concentration seems to be less effective than the longer ARRESTOR oligonucleotides (See, e.g., previous Example) this can be compensated for by increasing the concentration of ARRESTOR oligonucleotide, and thereby the ARRESTOR oligonucleotide:primary probe ratio.

In contrast, inclusion of the longer ARRESTOR oligonucleotide at 50, 100 or 200 pmoles produced products at 60, 32 and 24 fold over background, respectively. At the lowest concentration, the efficacy of this longer ARRESTOR oligonucleotide relative to the shorter ARRESTOR oligonucleotide is consistent with the previous Example. Increasing the concentration, however, decreased the yield of specific product, suggesting a competition effect with some element of the secondary cleavage reaction.

These data show that the ARRESTOR oligonucleotides can be used to advantage in a number of specific reaction designs. The choice of concentration will be influenced by the temperature at which the reaction making use of the ARRESTOR oligonucleotide is performed, the lengths of the duplexes formed between the primary probe and the target, the primary probe and the secondary target, and between the primary probe and the ARRESTOR oligonucleotide.

Selection of oligonucleotides for target nucleic acids other than the HBV shown here, (e.g., oligonucleotide composition and length), and the optimization of cleavage reaction conditions in accord with the models provided here follow routine methods and common practice well known to those skilled in the methods of molecular biology.

Example 10 demonstrated that some enzymes require an overlap between an upstream INVADER oligonucleotide and a downstream probe oligonucleotide to create a cleavage structure (FIG. 27). It has also been determined that the 3' terminal nucleotide of the INVADER oligonucleotide need not be complementary to the target strand, even if it is the only overlapping base in the INVADER oligonucleotide (e.g., as with the HCMV probes shown in FIG. 30). The requirement for an overlap can serve as a convenient basis for detecting single base polymorphisms (SNPs) or mutations in a nucleic acid sample.

For detection of single base variations, at least two oligonucleotides (e.g., a probe and an INVADER oligonucleotide) hybridize in tandem to the target nucleic acid to form the overlapping structure recognized by the CLEAVASE enzyme to be used in the reaction. An unpaired "flap" is included on the 5' end of the probe. The enzyme recognizes the overlap and cleaves off the unpaired flap, releasing it as a target-specific product. Enzymes that have a strong preference for an overlapping structure, i.e., that cleave the overlapping structure at a much greater rate than they cleave a non-overlapping structure include the FEN-1 enzymes from *Archaeoglobus fulgidus* and *Pyrococcus furiosus* and such enzymes are particularly preferred in the detection of mutations and SNPs.

Example 19

Kits for Performing the mRNA INVADER Assay

In some embodiments, the present invention provides kits comprising one or more of the components necessary for practicing the present invention. For example, the present invention provides kits for storing or delivering the enzymes of the present invention and/or the reaction components necessary to practice a cleavage assay (e.g., the INVADER assay). By way of example, and not intending to limit the kits of the present invention to any particular configuration or combination of components, the following section describes one embodiment of a kit for practicing the present invention:

In some embodiments, the kits of the present invention provide the following reagents:

| | |
|---|---|
| CLEAVASE enzyme (e.g., TthAKK) | Primary Oligos |
| RNA Primary Buffer 1 | Secondary Oligos |
| RNA Secondary Buffer 1 | RNA Standard [100 amol/µl] |
| tRNA Carrier [20 ng/µl] | 10X Cell Lysis Buffer 1 |
| $T_{10}e_{0.1}$ Buffer [10 mM Tris · HCl, pH 8, 0.1 mM EDTA] | |

Examples of Primary Oligonucleotides and Secondary Oligonucleotides suitable for use with the methods of the present invention are provided in FIG. 41. While the oligonucleotides shown therein may find use in a number of the methods, and variations of the methods, of the present invention, these INVADER assay oligonucleotide sets find particular use with kits of the present invention. The oligonucleotide sets shown in FIG. 41 may be used as individual sets to detect individual target RNAs, or may be comined in biplex or multiplex reactions for the detection of two or more analytes or controls in a single reaction. It is contemplated that the designs of these probes sets (e.g., the oligonucleotides and/or their sequences) may be adapted for use in DNA detection assays, using the guidelines for reaction design and optimization provided herein. Additional oligonucleotides that find use in detection assays and kits of the present invention are provided in FIG. 47.

In some embodiments, a kit of the present invention provides a list of additional components (e.g., reagents, supplies, and/or equipment) to be supplied by a user in order to perform the methods of the invention. For example, and without intending to limit such additional components lists to any particular components, one embodiment of such a list comprises the following:

RNase-free (e.g., DEPC-treated) $H_2O$

Clear CHILLOUT-14 liquid wax (MJ Research) or RNase-free, optical grade mineral oil (Sigma, Cat. No. M-5904)

Phosphate-buffered saline (no $MgCl_2$, no $CaCl_2$)
96-well polypropylene microplate (MJ Research, Cat. No. MSP-9601)
0.2-ml thin-wall tubes
Thermaseal well tape (e.g., GeneMate, Cat. No. T-2417-5)
Multichannel pipets (0.5–10 µl, 2.5–20 µl, 20–200 µl)
Thermal cycler or other heat source (e.g., lab oven or heating block).
Fluorescence microplate reader (a preferred plate reader is top-reading, equipped with light filters have the following characteristics:

| Excitation (Wavelength/Bandwidth) | Emission (Wavelength/Bandwidth) |
|---|---|
| 485 nm/20 nm | 530 nm/25 nm |
| 560 nm/20 nm | 620 nm/40 nm |

In some embodiments, a kit of the present invention provides a list of optional components (e.g., reagents, supplies, and/or equipment) to be supplied by a user to facilitate performance of the methods of the invention. For example, and without intending to limit such optional components lists to any particular components, one embodiment of such a list comprises the following:

tRNA Solution, 20 ng/µl (Sigma, R-5636)
1× Stop Solution (10 mM Tris.HCl, pH 8, 10 mM EDTA)
Black opaque, 96-well microplate (e.g., COSTAR, Cat. No. 3915)
Electronic repeat pipet (250 µl)

In some embodiments of a kit, detailed protocols are provided. In preferred embodiments, protocols for the assembly of INVADER assay reactions (e.g., formulations and preferred procedures for making reaction mixtures) are provided. In particularly preferred embodiments, protocols for assembly of reaction mixtures include computational or graphical aids to reduce risk of error in the performance of the methods of the present invention (e.g., tables to facilitate calculation of volumes of reagents needed for multiple reactions, and plate-layout guides to assist in configuring multi-well assay plates to contain numerous assay reactions). By way of example, and without intending to limit such protocols to any particular content or format, kits of the present invention may comprise the following protocol:

I. Detailed mRNA Invader Assay Protocol

1. Plan the microplate layout for each experimental run. An example microplate layout for 40 samples, 6 standards, and a No Target Control is shown in FIG. 40. Inclusion of a No Target Control (tRNA Carrier or 1× Cell Lysis Buffer 1) and quantitation standards are required for absolute quantitation.

2. Prepare the Primary Reaction Mix for either the single or biplex assay format. To calculate the volumes of reaction components needed for the assay (X Volume), multiply the number of reactions (for both samples and controls) by 1.25 [X Volume (µl)=# reactions×1.25]. Vortex the Primary Reaction Mix briefly after the last reagent addition to mix thoroughly. Aliquot 5 µl of the Primary Reaction Mix per microplate well (an electronic repeat pipet is recommended for this step).

| Primary Reaction Mix | | |
|---|---|---|
| Reaction Components | 1× Volume | __× Volume |
| Single Assay Format | | |
| RNA Primary Buffer 1 | 4.0 µl | |
| _Primary Oligos | 0.25 µl | |
| $T_{10}e_{0.1}$ Buffer | 0.25 µl | |
| CLEAVASE enz. enzyme | 0.5 µl | |
| Total Mix Volume (1×) | 5.0 µl | |
| Biplex Assay Format | | |
| RNA Primary Buffer 1 | 4.0 µl | |
| _Primary Oligos | 0.25 µl | |
| _Housekeeping Primary Oligos | 0.25 µl | |
| CLEAVASE enzyme | 0.5 µl | |
| Total Mix Volume (1×) | 5.0 µl | |

3. Add 5 µl of each No Target Control, standard, or sample (total RNA or cell lysate) to the appropriate well and mix by pipetting up and down 1–2 times. Overlay each reaction with 10 µl of clear CHILLOUT or mineral oil. Seal microplate with Thermaseal well tape.

4. Incubate reactions for 90 minutes at 60° C. in a thermal cycler or oven.

5. While the primary reaction is incubating, prepare the Secondary FRET Reaction Mix for the single or biplex format. Calculate the component volumes required (X Volume) by multiplying the number of reactions (for both samples and controls) by 1.25 [X Volume (µl)=# reactions×1.25 (µl)]. Aliquot the Secondary FRET Reaction Mix into multiple 0.2-ml thin-wall tubes or an 8-well strip (70 µl/tube is sufficient for a row of 12 reactions).

| Secondary FRET Reaction Mix | | |
|---|---|---|
| Reaction Components | 1× Volume | __× Volume |
| Single Assay Format | | |
| RNA Secondary Buffer 1 | 2.0 µl | |
| _Secondary Oligos | 1.5 µl | |
| $T_{10}e_{0.1}$ Buffer | 1.5 µl | |
| Total Mix Volume (1×) | 5.0 µl | |
| Biplex Assay Format | | |
| RNA Secondary Buffer 1 | 2.0 µl | |
| _Secondary Oligos | 1.5 µl | |
| _Housekeeping Secondary | 1.5 µl | |
| Total Mix Volume (1×) | 5.0 µl | |

6. After the primary reaction incubation is completed, remove the microplate seal, and add 5 µL Secondary FRET Reaction Mix per well using a multichannel pipet. Mix by pipetting up and down 1–2 times. Reseal the microplate with the well tape and incubate the microplate at 60° C. for 60 or 90 minutes, as indicated in each Product Information Sheet. The secondary reaction incubation time can be varied. See sections 2 of the PROCEDURAL NOTES FOR OPERATION OF THE mRNA INVADER ASSAY for details.

7. Reactions can be read using one of two procedures: Direct Read or Stop and Transfer.
NOTE: Remove the microplate seal before reading the microplate.

Direct Read Procedure

This procedure enables collection of multiple data sets to extend the assay's dynamic range. During the secondary INVADER reaction, read the microplate directly in a top-reading fluorescence microplate reader.

Recommended settings for a PerSeptive Biosystem Cytofluor 4000 instrument are as follows:

| Specific Gene Signal | | Housekeeping Gene Signal | |
|---|---|---|---|
| Excitation | 485/20 nm | Excitation | 560/20 nm |
| Emission | 530/25 nm | Emission | 620/40 nm |
| Reads/Well | 10 | Reads/Well | 10 |
| Gain | 40 | Gain | 45 |
| Temperature | 25° C. | Temperature | 25° C. |

NOTE:
Because the optimal gain setting can vary between instruments, adjust the gain as needed to give the best signal/background ratio (sample raw signal divided by the No Target Control signal) or No Target Control sample readings of ~100 RFUs. Fluorescence microplate readers that use a xenon lamp source generally produce higher RFUs. For directly reading the microplates, the probe height of, and how the plate is positioned in, the fluorescencemicroplate reader may need to be adjusted according to the manufacturer's recommendations.

Stop and Transfer Procedure
1. Prepare 1× Stop Solution (10 mM Tris.HCl, pH 8, 10 mM EDTA) with RNase-free $H_2O$. Add 100 µl per well with a multichannel pipet.
2. Transfer 100 µl of the diluted reactions to a black microplate (e.g., COSTAR (Corning), Cat. No. 3915).
3. Read the microplate using the same parameters as the Direct Read Procedure, but adjust the gain to give No Target Control sample readings of ~100 RFUs (see NOTE above).

In some embodiments, supplemenatary documentation, such as protocols for ancillary procedures, e.g., for the preparation of additional reagents, or for preparation of samples for use in the methods of the present invention, are provided. In preferred embodiments, supplementary documentation includes guidelines and lists of precautions provided to facilitate successful use of the methods and kits by unskilled or inexperienced users. In particularly preferred embodiments, supplementary documentation includes a troubleshooting guide, e.g., a guide describing possible problems that may be encountered by users, and providing suggested solutions or corrections to intended to aid the user in resolving or avoiding such problems.

For example, and without intending to limit such supplementary documentation to any particular content, kits of the present invention may comprise any of the following procedures and guidelines:

II. Avoidance of RNase Contamination

To avoid RNase contamination during sample preparation and testing, in one embodiment, the user is cautioned to observe the following precautions:

Wear disposable gloves at all times to avoid contact with samples and reagents.

Use certified RNase-free disposables, including thin-wall polypropylene tubes and aerosol-barrier pipet tips, for preparing samples and assay reagents, to avoid cross-contamination.

Use RNase-free (DEPC-treated) $H_2O$ for diluting samples and/or reagents.

Keep RNA samples and controls on ice during assay setup.

III. Sample and Control Preparation
NOTE: Dilute both standards and samples to concentrations that correspond to a 5-µl addition per reaction.
Example 1: The concentration of a 5-attomole standard is 1 amol/µl. 1 amol=$10^{-18}$ mole=602,000 molecules.
Example 2: The concentration of a 100-ng sample should be 20 ng/µl.

A. Control Preparation

No Target Control:
Total RNA Format: tRNA Carrier (20 ng/µl)
Cell Lysate Format: 1× Cell Lysis Buffer 1 (dilute 10× Cell Lysis Buffer 1 to 1× with RNase-free $H_2O$)

Positive Control: RNA Standard (Std) (100 amol/µl in vitro transcript)
1. Prepare RNA standards by diluting the positive controls with tRNA Carrier (when running total RNA samples) or with 1× Cell Lysis Buffer 1 [10× Cell Lysis Buffer 1 diluted with RNase-free $H_2O$] (when running cell lysate samples). The Product Information Sheet included in each kit indicates the recommended standard test levels and preparation methods.
2. Using a fresh set of standards for each run is recommended. Store the standards on ice during reaction setup.

B. Total RNA Sample Preparation
1. Prepare total RNA from cells or tissue according to manufacturer's instructions for the selected preparation method. Recommended methods include TRIZOL (Life Technologies, Rockville, Md.), RNEASY (Qiagen, Valencia, Calif.), and RNA WIZ (Ambion, Austin, Tex.).
2. Dilute total RNA samples with RNase-free $H_2O$ to the appropriate concentration.

C. Cell Lysate Sample Preparation—96-Well Microplate Format
NOTE: This cell lysate detection format is used for adherent cells cultured in 96-well tissue culture microplates. Cells are typically seeded at 10,000–40,000 cells per well. Different seeding densities may be required depending on cell type and/or mRNA expression levels. See Procedural Notes for more details. For cells exhibiting high expression, the following methods can be used to attenuate the signal from the cell lysates:
plate fewer cells per well;
dilute the cell lysates with 1× Cell Lysis Buffer 1 before addition to the reaction (e.g., 2.5 µl lysate+2.5 µl 1× Cell Lysis Buffer 1);
read the reaction microplate 15–30 minutes after addition of the Secondary FRET Reaction Mix instead of the recommended 60–90 minutes;
1. Dilute 10× Cell Lysis Buffer 1 to a 1× concentration with RNase-free $H_2O$.
2. Using a multichannel pipet, carefully remove the culture medium from the wells of adherent cells without disturbing the cell monolayer.
3. Wash the cells once with 200 µl PBS (no $MgCl_2$, no $CaCl_2$) and carefully remove the residual PBS with the multichannel pipet.
4. Add 40 µl 1× Cell Lysis Buffer 1 per well. Lyse cells at room temperature for 3–5 minutes.
5. Using a multichannel pipet, carefully transfer 25 µl of each lysate sample into a 96-well microplate. Avoid transferring cellular material from the bottom of the well.

6. Overlay each lysate sample with 10 μl clear CHILLOUT or mineral oil (overlaying is not necessary if using a heated-lid thermal cycler).
7. Seal microplate with Thermaseal well tape. Immediately heat lysates at 75–80° C. for 15 minutes in a thermal cycler or oven to inactivate cellular nucleases.
8. During the heating step, proceed with the reaction setup. See DETAILED mRNA INVADER ASSAY PROTOCOL (above) for instructions.
9. After the heat inactivation step, add the lysate samples immediately to the reaction microplate. Alternatively, the lysate samples can be quickly transferred to a −70° C. freezer for later testing (long-term stability has not been established and may differ for each cell type).

IV. Procedural Notes for Operation of the mRNA Invader Assay

1. RNA sample types and optimization of RNA sample amount.

The assay is optimized for performance with total RNA samples prepared from either tissue or cells. Several total RNA preparation methods/kits have been validated for performance in the mRNA INVADER assay:
TRIZOL (Life Technologies, Rockville, Md.)
RNeasy (Qiagen, Valencia, Calif.)
RNA WIZ (Ambion, Austin, Tex.)

It is important to use a method or kit that minimizes the level of genomic DNA, which can inhibit signal generation. Performance of a preliminary experiment is recommended to determine the amount of total RNA sample (typically 1–200 ng, depending on the gene's expression level) that provides the best limit of detection and dynamic range.

The assay has also been validated with lysate samples from a number of cell types. Recommended cell densities in a 96-well tissue culture microplate are 10,000–40,000 cells per well depending on cell type and expression level of the gene of interest. Performance of a preliminary experiment is recommended for any given cell line and/or gene being monitored. Such an experiment should include different cell density levels and/or dilution of the lysate samples with 1× Cell Lysis Buffer 1 (e.g. a 1 μl test level is prepared by mixing 1 μl lysate sample+4 μl 1× Cell Lysis Buffer 1 for a 5 μl sample addition).

2. Dynamic Range Modulation: Variable Secondary Reaction Incubation Times.

The length of the secondary reaction incubation time listed in the protocol is sufficient for most analytes. However, the linear detection range (Signal/Background<15–25) can be adjusted by reading the reaction microplate at variable times after addition of the secondary FRET reagents. For example, high expression samples can often be detected in 15–30 minutes. The Direct Read method (DETAILED mRNA INVADER ASSAY PROTOCOL, step 7) enables simple optimization of the secondary reaction time as the reaction microplate can be incubated further if an early time read does not provide enough signal from the samples being tested.

Monitoring the secondary reaction fluorescence signal with time can also extend the dynamic range of the assay. The Direct Read method at multiple time points can be applied using low-cost instrumentation. Alternatively, real-time fluorescence instrumentation can be used to achieve comparable dynamic ranges exhibited by other mRNA quantitation methods.

3. Dynamic Range Modulation: Variable Sample Levels.

While the FRET detection method greatly simplifies the assay, the dynamic range is typically limited to 2–3 logs when using an endpoint read method. However, since mRNA INVADER assay signal is generated linearly with both target level and time, the easiest method for extending the dynamic range beyond 3 logs (as may be required, e.g., for highly induced genes) is to adjust total RNA sample levels. Fold changes in gene expression (treated sample signal divided by untreated sample signal) can be reliably calculated using normalized sample signals. This is accomplished by testing sample levels that give signal within the linear detection range defined by the standard curve. For example, the fold induction for a highly induced sample can be calculated as follows:

Fold induction=(Net Signal for 1 ng treated sample×100)/ Net Signal for 100 ng untreated sample

| Problem | Possible Solution |
| --- | --- |
| No signal | Check that the fluorescence microplate reader has been set up correctly and that the appropriate excitation and emission filters are in place. |
| | Perform mRNA INVADER assay with the provided standard as a positive control. |
| | Potential RNase contamination of the samples and reagents. Discard suspect reagents. |
| | Use only reagents and oligonucleotides supplied in the kit. Do not mix reagents or oligonucleotides between kits. |
| High variation between replicates | Always work with master primary and secondary reaction mixes. Thoroughly mix all master mixes and samples. |
| | Pipet in a similar manner across all the controls and samples. Calibrate pipets frequently. |
| Lack of low target level detection | Calibrate thermal cycler or heat block. |
| | Minimize assay variability (see above), i.e. CVs are less than 5% for the sample replicates. This is particularly important for detecting low target levels. |
| Lack of discrimination between high signal samples | Decrease secondary reaction incubation time to achieve detection within the linear range of the assay. |
| | Use less total RNA per reaction. |
| | Attenuate cell lysate sample signal (see NOTE, Sample and Control Preparation, Part C). |

-continued

| Problem | Possible Solution |
|---|---|
| Signal inhibition | Run samples on an agarose gel to check for presence of genomic DNA. Alter the RNA sample isolation method to minimize genomic DNA or presence of other inhibitors. The same isolation procedure should be used throughout an experiment.<br>If using the cell lysate format, residual PBS can be inhibitory. Be sure to remove residual PBS from the tissue culture microplate. Do not use PBS that contains $MgCl_2$ or $CaCl_2$, which inhibits the assay. |

APPENDIX A:

mRNA INVADER SINGLE ASSAY WORKSHEET mRNA INVADER ASSAY PROCEDURE

- Prepare samples and controls.
- Prepare Primary Reaction Mix. Vortex briefly and aliquot 5µl per well.
- Add 5µl sample or control per well and pipet up and down 1–2 times.
- Add 10µl CHILLOUT or mineral oil per well.
- Incubate primary reaction at 60°C for 90 minutes.
- Prepare Secondary FRET Reaction Mix, vortex briefly.
- Using a multichannel pipet, aliquot 5µl per well and pipet up and down 1–2 times.
- Incubate secondary reaction at 60°C for 60 or 90 minutes.
- Read microplate in fluorescence microplate reader (FAM Dye: Ex. 485 nm/Em. 530 nm).

PRIMARY REACTION MIX

| Reaction Components | 1X Volume | ___X Volume (No. of reactions x 1.25) |
|---|---|---|
| RNA Primary Buffer 1 | 4.0µl | |
| ___Primary Oligos | 0.25µl | |
| $T_{10}e_{0.1}$ Buffer | 0.25µl | |
| CLEAVASEenzyme | 0.5µl | |
| Total Mix Volume (1X) | 5.0µl | |

SECONDARY FRET REACTION MIX

| Reaction Components | 1X Volume | ___X Volume (No. of reactions x 1.25) |
|---|---|---|
| RNA Secondary Buffer 1 | 2.0µl | |
| ___Secondary Oligos | 1.5µl | |
| $T_{10}e_{0.1}$ Buffer | 1.5µl | |
| Total Mix Volume (1X) | 5.0µl | |

APPENDIX B:

mRNA INVADER BIPLEX ASSAY WORKSHEET mRNA INVADER ASSAY PROCEDURE

- Prepare samples and controls.
- Prepare Primary Reaction Mix. Vortex briefly and aliquot 5μl per well.
- Add 5μl sample or control per well and pipet up and down 1–2 times.
- Add 10μl CHILLOUT or mineral oil per well.
- Incubate primary reaction at 60°C for 90 minutes.
- Prepare Secondary FRET Reaction Mix, vortex briefly.
- Using a multichannel pipet, aliquot 5μl per well and pipet up and down 1–2 times.
- Incubate secondary reaction at 60°C for 60 or 90 minutes.
- Read microplate in fluorescence microplate reader (FAM Dye: Ex. 485 nm/Em. 530 nm and red dye: Ex. 560nm/Em. 620nm).

PRIMARY REACTION MIX

| Reaction Components | 1X Volume | ___X Volume (# reactions x 1.25) |
|---|---|---|
| RNA Primary Buffer 1 | 4.0μl | |
| ___Primary Oligos | 0.25μl | |
| ___Housekeeping Primary Oligos | 0.25μl | |
| CLEAVASE IX enzyme | 0.5μl | |
| Total Mix Volume (1X) | 5.0μl | |

SECONDARY FRET REACTION MIX

| Reaction Components | 1X Volume | ___X Volume (# reactions x 1.25) |
|---|---|---|
| RNA Secondary Buffer 1 | 2.0μl | |
| ___Secondary Oligos | 1.5μl | |
| ___Housekeeping Secondary Oligos | 1.5μl | |
| Total Mix Volume (1X) | 5.0μl | |

Example 20

Additional RNA INVADER Assay Embodiments

1. ARRESTOR oligonucleotides in single-step INVADER assays.

ARRESTOR oligonucleotides can be used to selectively stop signal accumulation for particular target nucleic acids in a reaction, such that signal can continue to accumulate for other target nucleic acids in the same reaction mixture. The following is a description of one embodiment in which it is desirable to selectively arrest a particular reaction within a mixture.

The 18S ribosomal RNA is useful as an internal standard in RNA quantitation assays, e.g., for use in normalizing the signal generated from a specific gene or RNA of interest in the same sample. As an internal control, it is preferred that the signal should report both sample variability (e.g., dead cells in cell lysate samples, cell plating errors, RNA degradation in a particular total RNA sample) and assay variability (e.g., pipetting errors, uneven heating across the plate). Because 18S rRNA is present in samples such as cell lysates in relatively high concentrations compared, e.g., to most mRNAs, the 18S can often be detected in a single-step INVADER assay, without the need for a secondary or subsequent reaction. One consideration of running a single-step INVADER assay reaction in the same mixture as a multi-step INVADER assay reaction is that the multi-step reactions may involve changes of conditions (e.g., a solution addition or a temperature shift) between a primary reaction and subsequent reaction steps. For example, in the mRNA detection assays described herein, the primary reaction conditions are optimal for RNA detection, and the secondary reaction conditions are optimal for DNA detection. Accumulating single-step assay signal under two different conditions may complicate quantitation. Further, because of the high concentration of the 18S RNA, too much signal may sccumulate from this target. The reaction components may be exhausted, such that the signal reaches a plateau that is not an accurate reflection of the 18S concentration, or the accumulated signal may overwhelm the signal from other nucleic acids in the reaction. In some embodiments, it is preferable to limit the signal from the 18S rRNA. For example, a primary reaction with may be initiated with probe sets for the 18S rRNA and for one or more other targets. An ARRESTOR oligonucleotide to stop the 18S detection reaction may be added along with the secondary reaction reagents for the other target.

2. Reactions without Arrestor oligonucleotides.

Figure 50:
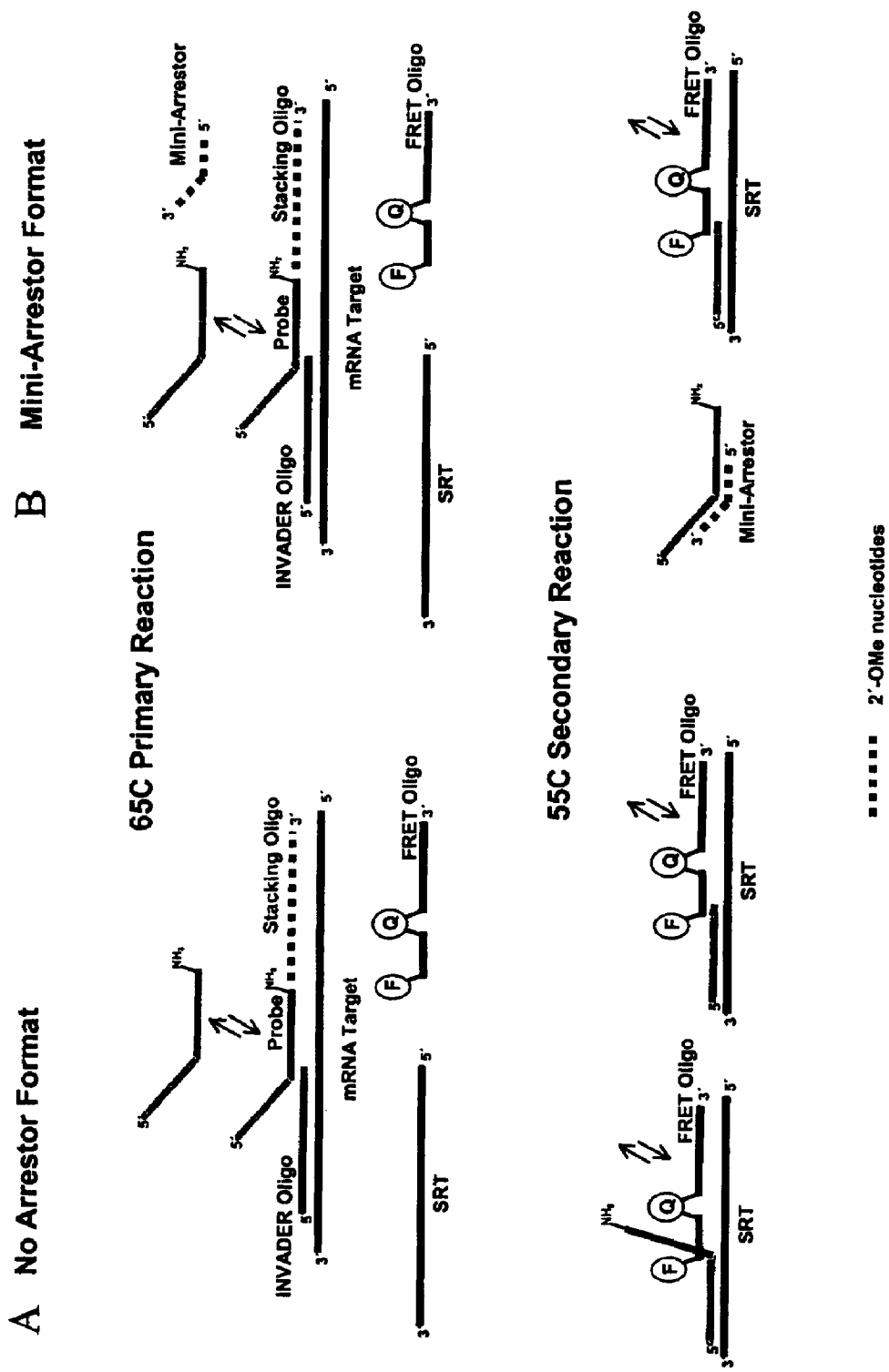
FIGS. 50A and B show schematic diagrams of two INVADER assay embodiments.

In some embodiments, this format involves running a high-temperature primary reaction (e.g. 65 C) and a low-temperature secondary reaction (e.g. 55 C) (e.g., FIG. 50A). All INVADER reaction reagents are combined at the same time, and temperature is used to segregate the primary and secondary reactions. In this embodiment, FRET background does not form in the primary reaction because the FRET oligonucleotide cannot stably bind to the secondary reaction template (SRT). In one embodiment of this format, the reaction components and conditions are as follows:

Reaction components
5–10 pmoles Probe
5 pmoles INVADER oligo
3 pmoles Stacking oligo
10 pmoles FRET oligo
6–12 pmoles SRT (1.2-fold excess over Probe level)
standard RNA reaction buffer
standard MgSO4 level
20 ng CLEAVASE enzyme (e.g., CLEAVASE VII, IX).

In preferred embodiments, primary reaction components are mixed and aliquoted into the reaction plate (e.g. 5 µl per well).

The RNA sample is added (e.g. in a 5 µl aliquot).

The reaction plate is incubated for 90 minutes (can be shorter or longer) at 65 C for the primary reaction.

The reaction plate is incubated for 15–90 minutes (depending on the expected expression level and assay sensitivity) at 55 C for the secondary reaction.

The plate (96-well or 384-well) is measured in a fluorescence plate reader.

In another embodiment, a Mini-Arrestor is provided (FIG. 50B) This format is run similarly to the No Arrestor format except that a Mini-Arrestor oligonucleotide is included as well. In some embodiments, Mini-Arrestor oligonucleotides may be synthesized with 2'-OMe nucleotides. When the temperature is reduced to start the secondary reaction, the remaining uncleaved Probe binds to the Mini-Arrestor instead of the SRT. Consequently, a FRET oligonucleotide in the secondary reaction binds only to the specific secondary substrate (comprising, e.g., cleaved 5' arm stably bound to an SRT).

TABLE 2

| Klenow | Kcat ($s^{-1}$) | Km (dNTP) (µM) | Kd (nM) affinity | Relative DNA | Reference | Taq Pol |
|---|---|---|---|---|---|---|
| Wild-Type | 2.4 | 2.8 | 8 | 1 | 2 | Wild-Type |
| S610A | n.d. | — | n.d. | — | 5 | S515 |
| R668A | 0.006 | 6.5 | 140, 150 | 0.06, 0.05 | 1,2 | R573* |
| N678A | n.d. | — | n.d. | — | 5 | N583 |
| E710A | 0.1 | 15 | 250 | 0.03 | 2 | E615* |
| E710D | 1.7 | 7.7 | 110 | 0.07 | 2 | E615* |
| K758A | 0.131 | 15.6 | — | 0.63 | 4 | K663 |
| K758R | 2.0 | 2.1 | — | 1.125 | 4 | K663 |
| Y766S | 0.8 | 6.4 | 13 | 0.4, 0.6 | 1,2 | Y671 |
| R841A | 0.3 | 9.8 | 40,53 | 0.2 | 1,2 | R746* |
| N845A | 1.0 | 23 | 8, 5 | 1.0, 1.7 | 1,2 | N750* |
| N845Q | 0.03 | 1.7 | 80, 55 | 0.1, 0.2 | 1,2 | N750* |
| Q849A | 0.02 | 3.8 | 100, 160 | 0.08, 0.05 | 1,2 | Q754 |
| Q849E | 0.001 | n.d. | 90, 91 | 0.09 | 1,2 | Q754 |
| H881A | 0.3 | 3.3 | 20, 28 | 0.4, 0.3 | 1,2 | H784* |
| D882N | <0.0001 | n.d. | 30 | 0.6 | 2 | D785 |
| D882S | 0.001 | 7.5 | 0.9 | 9 | 2 | D785 |

References

1. JBC (1990) 265:14579–14591
2. JBC (1992) 267:8417–8428
3. Eur. J. Biochem (1993) 214:59–65
4. JBC (1994) 269:13259–13265
5. Nature (1996) 382:278–281

TABLE 3

Rational mutations in the polymerase region

A. DNA activity table

|  | IdT | % Tth | % Taq 4M | HP | X |
|---|---|---|---|---|---|
| Tth DN RX HT | 31.91 | 100% | 83% | 3.81 | 101.9 |
| Tth DN RX HT H641A | 23.61 | 74% | 62% | 5.32 | 221.24 |
| Tth DN RX HT R748A | 22.1 | 69% | 58% | 4.39 | 88.17 |
| Tth DN RX HT H786A | 34.31 | 108% | 90% | 7.75 | 185.35 |
| Tth DN RX HT H786A/G506K/Q509K (AKK) | 32.1 | 101% | 84% | 5.7 | 332.8 |
| Taq DN RX HT W417L/G418K/E507Q/H784A (Taq 4M) | 38.23 | 120% | 100% | 68.21 | 1100.18 |
| Taq 4M G504K | 36.04 | 113% | 94% | 31.76 | 417.40 |
| Taq 4M H639A | 42.95 | 135% | 112% | 91.46 | 2249.67 |
| Taq 4M R587A | 44.78 | 140% | 117% | 143.0 | 252.69 |
| Taq DN RX HT W417L/G418K/G499R/A502K I503L/K504N/E07K/H784A (Taq 8M) | 43.95 | 138% | 115% | 122.53 | 346.56 |
| Taq SS R677A | 32.3 | 101% | 84% | 206.9 | 2450.0 |

B. RNA activity table

|  | IrT1 | % Tth | % Taq 4M |
|---|---|---|---|
| Tth DN RX HT | 0.89 | 100% | 34% |
| Tth DN RX HT H641A | 1.18 | 133% | 45% |
| Tth DN RX HT R748A | 1.34 | 151% | 51% |
| Tth DN RX HT H786A | 1.31 | 147% | 49% |
| Tth DN RX HT H786A/G506K/Q509K (AKK) | 1.59 | 179% | 60% |
| Taq DN RX HT W417L/G418K/E507Q/H784A (Taq 4M) | 2.65 | 298% | 100% |
| Taq 4M G5O4K | 2.76 | 310% | 114% |
| Taq 4M H639A | 3.89 | 437% | 147% |
| Taq 4M R587A | 3.13 | 352% | 118% |
| Taq DN RX HT W417L/G418K/G499R/A502K/I503L/K504N/E07K/H784A (Taq 8M) | 4.00 | 450% | 151% |
| Taq SS R677A | 2.22 | 249% | 84% |

TABLE 4

Rational arch mutations

DNA activity table

|  | IdT | % Tth | % Taq 4M | HP | X |
|---|---|---|---|---|---|
| Taq 4M P88E/P90E | 10.20 | 32% | 27% | 2.00 | 97.00 |
| Taq 4M G80E | 26.30 | 82% | 69% | 103.6 | 2900 |
| Taq 4M L109F/A110T | 36.45 | 114% | 95% | 19.71 | 749.69 |

RNA activity table

|  |  | IrT1 | % Tth | % Taq 4M |
|---|---|---|---|---|
| Taq 4M P88E/P90E | Taq 4M P88E/P90E | 0.10 | 11% | 4% |
| Taq 4M G80E | Taq 4M G80E | 3.11 | 349% | 117% |
| Taq 4M L109F/A110T | Taq 4M L109F/A110T | 2.45 | 275% | 92% |

TABLE 5

Arch/thumb combinations

DNA activity table

|  | IdT | % Tth | % Taq 4M | HP | X |
|---|---|---|---|---|---|
| Taq W417L/G418K/E507K/H784A/L109F/A110T/G499R/A502K/I503L/G504K/E507K/T514S (Taq SS) | 63.33 | 198% | 166% | 177.05 | 202.32 |
| Taq P88E/P9OE/W417L/G418K/G499R/A502K/I503L/G504K/E507K/T514S/H784A | 36.48 | 114% | 95% | 9.44 | 70.35 |

RNA activity table

|  | IrT1 | % Tth | % Taq 4M |
|---|---|---|---|
| Taq W417L/G418K/E507K/H784A/L109F/A110T/G499R/A502K/I503L/G504K/E507K/T514S (Taq SS) | 3.16 | 355% | 119% |
| Taq P88E/P9OE/W417L/G418K/G499R/A502K/I503L/G504K/E507K/T514S/H784A | 0.22 | 25% | 8% |

TABLE 6

Helix-hairpin-helix random mutagenesis

DNA activity table

|  | IdT | % Tth | % Taq 4M | HP | X |
|---|---|---|---|---|---|
| Taq SS K198N | 23.4 | 73% | 61% | 25.7 | 1233.1 |
| Taq SS A205Q | 25.6 | 80% | 67% | 13.4 | 699.1 |

TABLE 6-continued

Helix-hairpin-helix random mutagenesis

| | | | | | |
|---|---|---|---|---|---|
| Taq SS T204P | 11.2 | 35% | 29% | 1.9 | 209.4 |
| Taq SS I200M/A205 G | 16.8 | 53% | 44% | 7.8 | 597.2 |
| Taq SS K203N | 25.9 | 81% | 68% | 36.6 | 1429.8 |
| Tth DN RX HT H786A/P197R/K200R | 10.7 | 33% | 28% | 3.2 | 66.3 |
| Tth DN RX HT H786A/K205Y | 11.5 | 36% | 30% | 6.1 | 327.5 |
| Tth DN RX HT H786A/G203R | 18.3 | 57% | 48% | 2.1 | 98.8 |

RNA activity table

| | IrT1 | % Tth | % Taq 4M |
|---|---|---|---|
| Taq SS K198N | 1.22 | 137% | 46% |
| Taq SS A205Q | 0.62 | 70% | 23% |
| Taq SS T204P | 0.36 | 40% | 14% |
| Taq SS I200M/A205G | 0.77 | 87% | 29% |
| Taq SS K203N | 2.09 | 235% | 79% |
| Tth DN RX HT H786A/P197R/K200R | 0.47 | 52% | 18% |
| Tth DN RX HT H786A/K205Y | 0.68 | 77% | 26% |
| Tth DN RX HT H786A/G203R | 1.61 | 180% | 61% |

TABLE 7

Random thumb mutations

DNA activity table

| | IdT | % Tth | % Taq 4M | HP | X |
|---|---|---|---|---|---|
| Taq DN RX HT W417L/G418K/ E507K/H784A/G499R/ A502K/K504N/(M1-13) | 59.96 | 188% | 157% | 133.65 | 907.41 |
| Taq DN RX HT W417L/G418K/ /H784A/L500I/Q507H A502K/G504K (M1-36) | 46.74 | 146% | 122% | 123.11 | 822.61 |
| Taq DN RX HT W417L/G418K/G499R/ A502K/G504K/E507K/ H784A/T514S (M2-24) | 85.7 | 269% | 224% | 369.96 | 3752.12 |
| Taq DN RX HT W417L/G418K/G499R/ A502K/G504K/E507K/ H784A/V518L (M2-06) | 76.7 | 240% | 201% | 355.87 | 2038.19 |

RNA activity table

| | IrT1 | % Tth | % Taq 4M |
|---|---|---|---|
| Taq DN RX HT W417L/G418K/ E507K/H784A/G499R/ A502K/K504N/ (M1-13) | 2.55 | 287% | 96% |
| Taq DN RX HT W417L/G418K/ /H784A/L500I/Q507H A502K/G504K (M1-36) | 2.71 | 304% | 102% |
| Taq DN RX HT W417L/G418K/G499R/ A502K/G504K/E507K/ H784A/T514S (M2-24) | 4.43 | 498% | 167% |
| Taq DN RX HT W417L/G418K/G499R/ A502K/G504K/E507K/ H784A/V518L (M2-06) | 3.56 | 400% | 134% |

TABLE 8

Chimeric mutants

A. DNA activity table

| | IdT2 | % Tth AKK | HP | X |
|---|---|---|---|---|
| Tth AKK | 34.18 | 100% | 5 | 393 |
| Taq 4M G504K | 40.19 | 105% | 28 | 1991 |
| Tfi DN 2M | 36.60 | 106% | 289 | 1326 |
| Tsc DN 2M | 25.49 | 75% | 283 | 2573 |
| Taq Tth AKK | 63.89 | 187% | 32 | 1658 |
| Tth Taq 4M G504K | 25.03 | 73% | 8 | 627 |
| Tfi Tth AKK | 34.13 | 100% | 15 | 459 |
| Tsc Tth AKK | 35.23 | 103% | 29 | 2703 |
| Tfi Taq 4M G5O4K | 35.69 | 104% | 37 | 872 |
| Tsc Taq 4M G504K | 30.04 | 88% | 25 | 2008 |

B. RNA activity table

| | IrT3 | % Tth AKK |
|---|---|---|
| Tth AKK | 2.27 | 100% |
| Taq 4M G5O4K | 2.31 | 102% |
| Tfi DN 2M | 0.20 | 9% |
| Tsc DN 2M | 0.29 | 13% |
| Taq Tth AKK | 6.81 | 300% |
| Tth Taq 4M G504K | 1.09 | 48% |
| Tfi Tth AKK | 1.24 | 55% |
| Tsc Tth AKK | 9.65 | 4.25% |
| Tfi Taq 4M G504K | 1.05 | 46% |
| Tsc Taq 4M G504K | 2.95 | 130% |

Figure 47A-62:
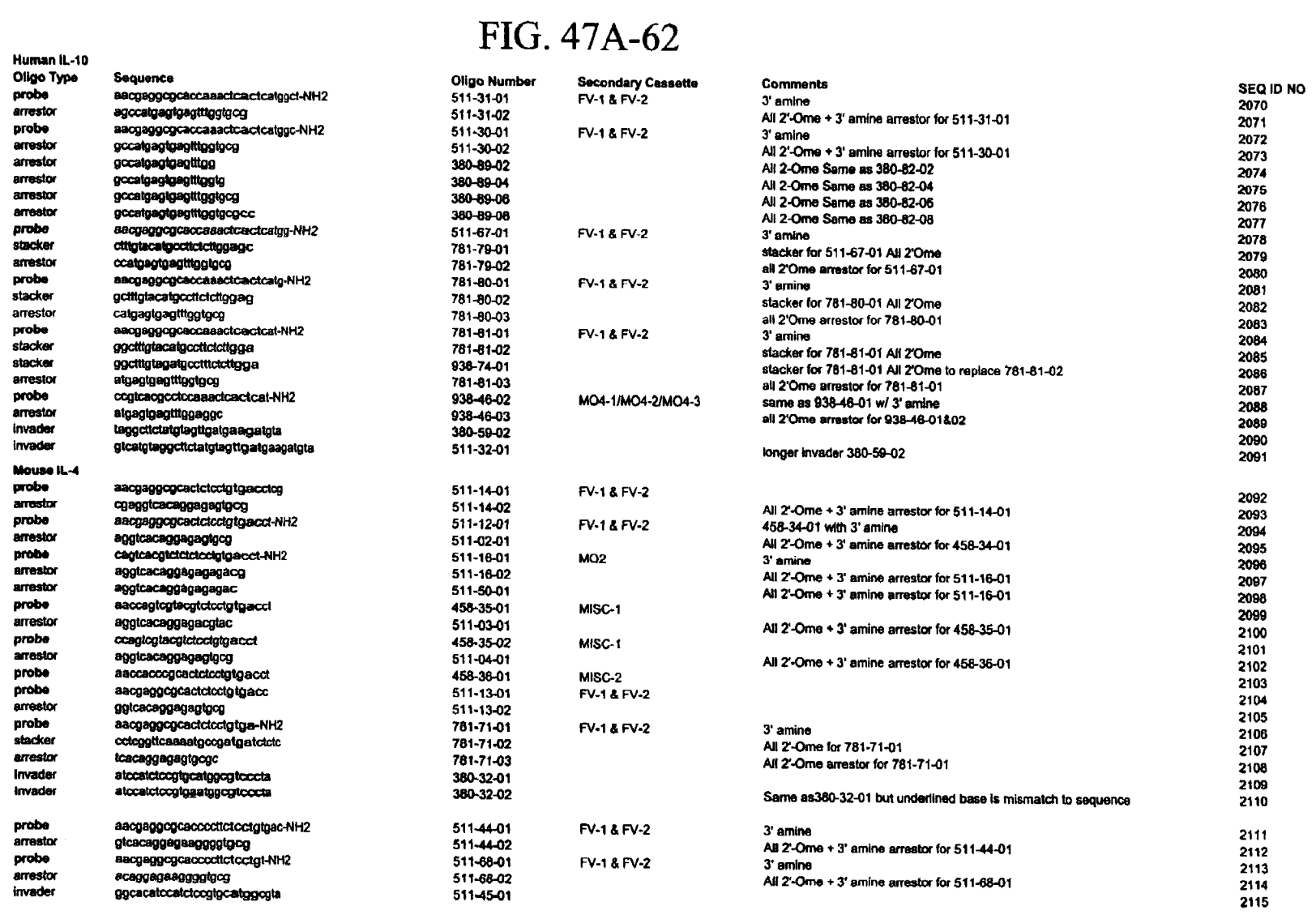

In FIGS. 47 and 49, and throughout the specification, the terms "Z21", "Z28" and "EQ" refer to ECLIPSE Quencher dye. "Red" and "RR" denote the REDMOND RED dye. "Epoch Yellow" refers to YAKIMA YELLOW dye. All of these dyes and quenchers are available from Synthetic Genetics, San Diego, Calif.

All publications and patents mentioned in the above specification are herein incorporated by reference. Various modifications and variations of the described methods and systems of the invention will be apparent to those skilled in the art without departing from the scope and spirit of the invention. Although the invention has been described in connection with specific preferred embodiments, it should be understood that the invention as claimed should not be unduly limited to such specific embodiments. Indeed, various modifications of the described modes for carrying out the invention which are obvious to those skilled in the relevant fields are intended to be within the scope of the following claims.

SEQUENCE LISTING (4004 sequences)

SEQ ID NO: 1 - protein, 834 aa, Thermus aquaticus
MEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRDGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVHDELLLEAPQARAEEVAALAKEAMEKAYPLAVPLEVEVGMGEDWLSAKG

SEQ ID NO: 2 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVHNELLLEAPQARAEEVAALAKEAMEKAYPLAVPLEVEVGMGEDWLSAKGHHHHHH

SEQ ID NO: 3 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 4 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 5 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVHNELLLEAPQARAEEVAALAKEAMEKAYPLAVPLEVEVGMGEDWLSAKGHHHHHH

SEQ ID NO: 6 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 7 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 8 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 9 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 10 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 11 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVHNELLLEAPQARAEEVAALAKEAMEKAYPLAVPLEVEVGMGEDWLSAKGHHHHHH

SEQ ID NO: 12 - protein, 833 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVHDELLLEAPQARAEEVAALAKEAMEKAYPLAVPLEVEVGMGEDWLSAKG

SEQ ID NO: 13 - protein, 833 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKE

SEQ ID NO: 14 - protein, 833 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVHDELLLEAPQARAEEVAALAKEAMEKAYPLAVPLEVEVGMGEDWLSAKG

SEQ ID NO: 15 - protein, 833 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELGLPAIGKTQKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKE

SEQ ID NO: 16 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGHRAALSERLFANLWGRLEGEERLLWLYREVERPLSAVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 17 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLHRNLWGRLEGEERLLWLYREVERPLSAVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 18 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 19 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSRVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 20 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 21 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRLDVAYLQALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 22 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRLDVAYLRALSLELAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 23 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRLDVAYLRALSLEVAEEIRRLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 24 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRLDVAYLRALSLEVAEEIARLEEEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 25 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRLDVAYLRALSLEVAEEIARLEAEVFRLAGHPFNLNSRDQLERVLFDELRLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 26 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRLDVAYLRALSLEVAEEIARLEAEVFRLAGHPFNLNSRDQLERVLFDELGLPAIGKTQKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 27 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRLDVAYLRALSLEVAEEIARLEAEVFRLAGHPFNLNSRDQLERVLFDELGLPAIGKTEKTGKRSTSAAVLEALREAHPIVEKILQHRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 28 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKNTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 29 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYVDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 30 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPSLVHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 31 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELGLPAIGKTQKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 32 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLGRLEGEERLLWLYREVERPLSAVLAHMEATGVRLDVAYLRALSLEVAEEIARLEAEVFRLAGHPFNLNSRDQLERVLFDELGLPAIGKTQKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 33 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWKRLEGEERLLWLYREVERPLSAVLAHMEATGVRLDVAYLRALSLEVAEEIARLEAEVFRLAGHPFNLNSRDQLERVLFDELGLPAIGKTQKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 34 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRDGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIATQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVHNELLLEAPQARAEEVAALAKEAMEKAYPLAVPLEVEVGMGEDWLSAKGHHHHHH

SEQ ID NO: 35 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAEAMAFNMPVQGTAADLMKLAMVKLFPRLREMGARMLLQVHNELLLEAPQARAEEVAALAKEAMEKAYPLAVPLEVEVGMGEDWLSAKGHHHHHH

SEQ ID NO: 36 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 37 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 38 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELGLPAIGKTQKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 39 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELGLPAIGKTQKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIATETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 40 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELGLPAIGKTQKTGKRSTSAAVLEALREAHPIVEKILQYRELTKLKSTYIDPLPDLIHPRTGRLHTRFNQTATATGRLSSSDPNLQNIPVATPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 41 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELGLPAIKKTQKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 42 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYEGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELGLPAIGKTQKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 43 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAETEEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELGLPAIGKTQKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 44 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELGLPAIGKTQKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 45 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELRLPKLKKTKKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 46 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELRLPKINKTKKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 47 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELRIPKIKKTHKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 48 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELRLPKLKKTKKTGKRSSSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 49 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELRLPKLKKTKKTGKRSTSAALLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 50 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLRGVRGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 51 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEYTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 52 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIREKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 53 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELRLPKLKKTKKTGKRSSSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 54 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAETEEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELRLPKLKKTKKTGKRSSSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 55 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVNGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELRLPKLKKTKKTGKRSSSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 56 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVKGIGEKTQRKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELRLPKLKKTKKTGKRSSSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 57 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVKGMGEKTGRKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELRLPKLKKTKKTGKRSSSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 58 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVKGIGENTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELRLPKLKKTKKTGKRSSSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 59 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVKGIGEKPARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELRLPKLKKTKKTGKRSSSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 60 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELRLPKLKKTKKTGKRSSSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHALSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 61 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 62 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELGLPAIKKTQKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 63 - protein, 835 aa, Artificial Sequence
  Synthetic
MEFTPLFDLEEPPKRVLLVDGHHLAYRTFYALSLTTSRGEPVQMVYGFARSLLKALKEDGQAVVVVFDAKAPSFRHEAYEAYKAGRAPTPEDFPRQLALVKRLVDLLGLVRLEAPGYEADDVLGTLAKKAEREGMEVRILTGDRDFFQLLSEKVSVLLPDGTLVTPKDVQEKYGVPPERWVDFRALTGDRSDNIPGVAGIGEKTALRLLAEWGSVENLLKNLDRVKPDSLRRKIEAHLEDLHLSLDLARIRTDLPLEVDFKALRRRTPDLEGLRAFLEELEFGSLLHEFGLLGGEKPREEAPWPPPEGAFVGFLLSRKEPMWAELLALAAASEGRVHRATSPVEALADLKEARGFLAKDLAVLALREGVALDPTDDPLLVAYLLDPANTHPEGVARRYGGEFTEDAAERALLSERLFQNLFKRLSEKLLWLYQEVERPLSRVLAHMEARGVRLDVPLLEALSFELEKEMERLEGEVFRLAGHPFNLNSRDQLERVLFDELGLTPVGRTQKTGKRSTAQGALEALRGAHPIVELILQYRELSKLKSTYLDPLPRLVHPRTGRLHTRFNQTATATGRLSSSDPNLQNIPVRTPLGQRIRKAFVAEEGWLLLAADYSQIELRVLAHLSGDENLKRVFREGKDIHTETAAWMFGLDPALVDPKMRRAAKTVNFGVLYGMSAHRLSQELGIDYKEAEAFIERYFQSFPKVRAWIERTLEEGRTRGYVETLFGRRRYVPDLASRVRSVREAAERMAFNMPVQGTAADLMKIAMVKLFPRLKPLGAHLLLQVHNELVLEVPEDRAEEAKALVKEVMENAYPLDVPLEVEVGVGRDWLEAKQD

SEQ ID NO: 64 - protein, 832 aa, Artificial Sequence
  Synthetic
MEFLPLFEPKGRVLLVDGHHLAYRTFFALKGLTTSRGEPVQAVYGFAKSLLKALREDGDVVIVVFDAKAPSFRHQTYEAYKAGRAPTPEDFPRQLALIKEMVDLLGLERLEVPGFEADDVLATLAKKAEKEGYEVRILTADRDLYQLLSERISILHPEGYLITPEWLWEKYGLKPSQWVDYRALAGDPSDNIPGVKGIGEKTAAKLIREWGSLENLLKHLEQVKPASVREKILSHMEDLKLSLELSRVHTDLLLQVDFARRREPDREGLKAFLERLEFGSLLHEFGLLESPVAAEEAPWPPPEGAFVGYVLSRPEPMWAELNALAAAWEGRVYRAEDPLEALRGLGEVRGLLAKDLAVLALREGIALAPGDDPMLLAYLLDPSNTAPEGVARRYGGEWTEEAGERALLSERLYAALLKRLKGEERLLWLYEEVEKPLSRVLAHMEATGVRLDVAYLKALSLEVEAEIRRFEEEVHRLAGHPFNLNSRDQLERVIFDELGLPAIGKTQKTGKRSTSAAVLEALREAHPIVDRILQYRELSKLKGTYIDPLPALVHPKTNRLHTRFNQTATATGRLSSSDPNLQNIPVRTPLGQRIRRAFVAEEGWRLVVLDYSQIELRVLAHLSGDENLIRVFQEGQDIHTQTASWMFGVPPEAVDSLMRRAAKTINFGVLYGMSAHRLSGELAIPYEEAVAFIERYFQSYPKVRAWIEKTLAEGRERGYVETLFGRRRYVPDLASRVKSIREAAERMAFNMPVQGTAADLMKLAMVKLFPRLQELGARMLLQVHNELVLEAPKEQAEEVAQEAKRTMEEVWPLKVPLEVEVGIGEDWLSAKA

SEQ ID NO: 65 - protein, 842 aa, Artificial Sequence
  Synthetic
MNSTPLFDLEEPPKRVLLVDGHHLAYRTFYALSLTTSRGEPVQMVYGFARSLLKALKEDGQAVVVVFDAKAPSFRHEAYEAYKAGRAPTPEDFPRQLALVKRLVDLLGLVRLEAPGYEADDVLGTLAKKAEREGMEVRILTGDRDFFQLLSEKVSVLLPDGTLVTPKDVQEKYGVPPERWVDFRALTGDRSDNIPGVAGIGEKTALRLLAEWGSVENLLKNLDRVKPDSLRRKIEAHLEDLHLSLDLARIRTDLPLEVDFKALRRRTPDLEGLRAFLEELEFGSLLHEFGLLGGEKPREEAPWPPPEGAFVGFLLSRKEPMWAELLALAAASGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 66 - protein, 838 aa, Artificial Sequence
  Synthetic
MNSLPLFEPKGRVLLVDGHHLAYRTFFALKGLTTSRGEPVQAVYGFAKSLLKALREDGDVVIVVFDAKAPSFRHQTYEAYKAGRAPTPEDFPRQLALIKEMVDLLGLERLEVPGFEADDVLATLAKKAEKEGYEVRILTADRDLYQLLSERISILHPEGYLITPEWLWEKYGLKPSQWVDYRALAGDPSDNIPGVKGIGEKTAAKLIREWGSLENLLKHLEQVKPASVREKILSHMEDLKLSLELSRVHTDLLLQVDFARRREPDREGLKAFLERLEFGSLLHEFGLLESPVAAEEAPWPPPEGAFVGYVLSRPEPMWAELNALAAAWGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 67 - protein, 842 aa, Artificial Sequence
  Synthetic
MNSTPLFDLEEPPKRVLLVDGHHLAYRTFYALSLTTSRGEPVQMVYGFARSLLKALKEDGQAVVVVFDAKAPSFRHEAYEAYKAGRAPTPEDFPRQLALVKRLVDLLGLVRLEAPGYEADDVLGTLAKKAEREGMEVRILTGDRDFFQLLSEKVSVLLPDGTLVTPKDVQEKYGVPPERWVDFRALTGDRSDNIPGVAGIGEKTALRLLAEWGSVENLLKNLDRVKPDSLRRKIEAHLEDLHLSLDLARIRTDLPLEVDFKALRRRTPDLEGLRAFLEELEFGSLLHEFGLLGGEKPREEAPWPPPEGAFVGFLLSRKEPMWAELLALAAASGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELGLPAIKKTQKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 68 - protein, 838 aa, Artificial Sequence
  Synthetic
MNSLPLFEPKGRVLLVDGHHLAYRTFFALKGLTTSRGEPVQAVYGFAKSLLKALREDGDVVIVVFDAKAPSFRHQTYEAYKAGRAPTPEDFPRQLALIKEMVDLLGLERLEVPGFEADDVLATLAKKAEKEGYEVRILTADRDLYQLLSERISILHPEGYLITPEWLWEKYGLKPSQWVDYRALAGDPSDNIPGVKGIGEKTAAKLIREWGSLENLLKHLEQVKPASVREKILSHMEDLKLSLELSRVHTDLLLQVDFARRREPDREGLKAFLERLEFGSLLHEFGLLESPVAAEEAPWPPPEGAFVGYVLSRPEPMWAELNALAAAWGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELGLPAIKKTQKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 69 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtccacaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 70 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgtgggggaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 71 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 72 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgtgggggaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtccacaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 73 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 74 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgtgggggaggcttgagggggaggagaggctcctttggctttaccgggaggtggagaggcccctttccgctgtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 75 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 76 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcccggcgctacggcggggagtggacggaggaggcgggggagcgggccgccctttccgagaggctcttcgccaacctgtgggggaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 77 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 78 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgtgggggaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtccacaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 79 - DNA, 2499 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtccacgacgagctcctcctggaggccccccaagcgcgggccgaggaggtggcggctttggccaaggaggccatggagaaggcctatcccctcgccgtgcccctggaggtggaggtggggatgggggaggactggctttccgccaagggt

SEQ ID NO: 80 - DNA, 2499 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacgacgagctggtcctcgaggccccaaaagagagggcggaggccgtggcccggctggccaaggaggtcatggagggggtgtatcccctggccgtgcccctggaggtggaggtggggataggggaggactggctctccgccaaggag

SEQ ID NO: 81 - DNA, 2499 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgtgggggaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtccacgacgagctcctcctggaggccccccaagcgcgggccgaggaggtggcggctttggccaaggaggccatggagaaggcctatcccctcgccgtgcccctggaggtggaggtggggatgggggaggactggctttccgccaagggt

SEQ ID NO: 82 - DNA, 2499 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacgcaaaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacgacgagctggtcctcgaggccccaaaagagagggcggaggccgtggcccggctggccaaggaggtcatggagggggtgtatcccctggccgtgcccctggaggtggaggtggggataggggaggactggctctccgccaaggag

SEQ ID NO: 83 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcggggcaccgggccgccctttccgagaggctcttcgccaacctgtgggggaggcttgagggggaggagaggctcctttggctttaccgggaggtggagaggcccctttccgctgtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 84 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctccatcggaacctgtgggggaggcttgagggggaggagaggctcctttggctttaccgggaggtggagaggcccctttccgctgtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 85 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 86 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgtgggggaggcttgagggggaggagaggctcctttggctttaccgggaggtggagaggcccctttcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 87 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccacgggggtgcgccgggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 88 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccacgggggtgcgcctggacgtggcctatctccaggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 89 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccacgggggtgcgcctggacgtggcctatctcagggccttgtccctggagcttgccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 90 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccacgggggtgcgcctggacgtggcctatctcagggccttgtccctggaggtggccgaggagatccgccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 91 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccacgggggtgcgcctggacgtggcctatctcagggccttgtccctggaggtggccgaggagatcgcccgcctcgaggaggaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 92 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctaaggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 93 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacgcaaaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 94 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagcaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 95 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagaacacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 96 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacgtggaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 97 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccgagcctcgtccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 98 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacgcaaaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 99 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttgggaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacgcaaaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 100 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgtggaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacgcaaaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 101 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcagggacggccgggtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatcgccacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtccacaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 102 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggaggccatggccttcaacatgcccgtccagggcaccgccgccgacctcatgaagctcgccatggtgaagctcttcccccgcctccgggagatgggggcccgcatgctcctccaggtccacaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 103 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 104 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 105 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacgcaaaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 106 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacgcaaaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatcgccacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 107 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacgcaaaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtcgccaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 108 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcaagaagacgcaaaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 109 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacgaggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacgcaaaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 110 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggccgagacggaggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacgcaaaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 111 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacgcaaaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 112 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctcaggcttcccaagttgaagaagacgaagaagaccggtaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 113 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctaaggcttcccaagatcaacaagacgaagaagaccggtaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 114 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctaaggattcccaagatcaagaagacgcataagaccggtaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 115 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctcaggcttcccaagttgaagaagacgaagaagaccggtaagcgctccagcagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 116 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctcaggcttcccaagttgaagaagacgaagaagaccggtaagcgctccaccagcgccgccctcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 117 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccgaggggtcaggggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 118 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagtataccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 119 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcagggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 120 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctcaggcttcccaagttgaagaagacgaagaagaccggtaagcgctccagcagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 121 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggccgagacggaggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctcaggcttcccaagttgaagaagacgaagaagaccggtaagcgctccagcagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 122 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaatggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctcaggcttcccaagttgaagaagacgaagaagaccggtaagcgctccagcagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 123 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacgcagaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctcaggcttcccaagttgaagaagacgaagaagaccggtaagcgctccagcagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 124 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatgggggagaagacggggaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctcaggcttcccaagttgaagaagacgaagaagaccggtaagcgctccagcagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 125 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaatacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctcaggcttcccaagttgaagaagacgaagaagaccggtaagcgctccagcagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 126 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagccggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctcaggcttcccaagttgaagaagacgaagaagaccggtaagcgctccagcagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 127 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctcaggcttcccaagttgaagaagacgaagaagaccggtaagcgctccagcagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccacgccctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 128 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 129 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcaagaagacgcaaaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 130 - DNA, 2508 bp, Artificial Sequence
  Synthetic
atggaattcaccccactttttgacctggaggaaccccccaagcgggtgcttctggtggacggccaccacctggcctaccgcaccttctatgccctgagcctcaccacctcccggggggagccggtgcagatggtctacggcttcgcccggagcctcctcaaggccttgaaggaggacggacaggcggtggtcgtggtctttgacgccaaggccccctccttccgccacgaggcctacgaggcctacaaggcgggccgggcccccaccccggaggacttcccccgccagctcgccttggtcaagcggctggtggaccttctgggcctggtccgcctcgaggccccggggtacgaggcggacgacgtcctgggcaccctggccaagaaggccgaaagggaggggatggaggtgcgcatcctcacgggagaccgggacttcttccagctcctctccgagaaggtctcggtcctcctgccggacgggaccctggtcaccccaaaggacgtccaggagaagtacggggtgcccccggagcgctgggtggacttccgcgccctcacgggggaccgctcggacaacatccccggggtggcggggataggggagaagaccgcccttcgactcctcgcagagtgggggagcgtggaaaacctcctgaagaacctggaccgggtaaagccggactcgctccggcgcaagatagaggcgcacctcgaggacctccacctctccttagacctggcccgcatccgcaccgacctccccctggaggtggactttaaggccctgcgccgcaggacccccgacctggagggcctgagggcctttttggaggagctggagttcggaagcctcctccacgagttcggcctcctgggaggggagaagccccgggaggaggccccctggcccccgcccgaaggggccttcgtgggcttcctcctttcccgcaaggagcccatgtgggcggagcttctggccctggcggcggcctcggagggccgggtccaccgggcaacaagcccggttgaggccctggccgacctcaaggaggcccgggggttcctggccaaggacctggccgttttggccctgcgggagggggtggccctggaccccacggacgaccccctcctggtggcctacctcctggacccggccaacacccaccccgagggggtggcccggcgctacgggggcgagttcacggaggacgcagcggagagggccctcctctccgagaggctcttccagaacctctttaaacggctttccgagaagctcctctggctctaccaggaggtggagcggcccctctcccgggtcttggcccacatggaggcccggggggtgaggctggacgtcccccttctggaggccctctcctttgagctggagaaggagatggagcgcctggagggggaggtcttccgtttggccggccaccccttcaacctcaactcccgcgaccagctggaaagggtcctctttgacgagctgggcctcaccccggtgggccggacgcagaagacgggcaagcgctccaccgcccagggggccctggaggccctccggggggcccaccccatcgtggagctcatcctccagtaccgggagctttccaagctcaaaagcacctacctggaccccctgccccggctcgtccacccgcggacgggccggctccacacccgcttcaaccagacggccacggccacgggaaggctttccagctccgaccccaacctgcagaacatccccgtgcgcacccccttggggcagcgcatccgcaaggccttcgtggccgaggaggggtggctccttttggcggcggactactcccagattgagctccgggtcctggcccacctctcgggggacgagaacctgaagcgggtcttccgggaggggaaggacatccataccgagaccgccgcctggatgttcggcttagaccccgctctggtggatccaaagatgcgccgggcggccaagacggtcaacttcggcgtcctctacgggatgtccgcccacaggctctcccaggagctcggcatagactacaaggaggcggaggcctttattgagcgctacttccagagcttccccaaggtgcgggcctggatagaaaggaccctggaggagggccggacgcggggctacgtggagaccctgttcggcaggaggcgctatgtgcccgacctggcctcccgggtccgctcggtgcgggaggcggcggagcggatggccttcaacatgcccgtgcagggcaccgccgccgacctgatgaagatcgccatggtcaagctcttccccaggctaaagcccctgggggcccacctcctcctccaagtgcacaacgagctggtcctggaggtgcccgaggaccgggccgaggaggccaaggccctggtcaaggaggtcatggagaacgcctaccccctggacgtgcccctcgaggtggaggtgggcgtgggtcgggactggctggaggcgaagcaggattga

SEQ ID NO: 131 - DNA, 2499 bp, Artificial Sequence
  Synthetic
atggaattcctgcccctctttgagcccaagggccgggtgcttctggtggacggccaccacctggcctaccgtaccttttttgccctgaagggcctcaccaccagccgcggggagccggtccaggcggtgtacgggtttgccaagagccttttgaaggcgctaagggaagacggggatgtggtgatcgtggtgtttgacgccaaggccccctccttccgccaccagacctacgaggcctacaaggcggggcgggctcccacccccgaggactttccccggcagcttgcccttatcaaggagatggtggaccttttgggcctggagcgcctcgaggtgccgggctttgaagcggatgacgtcctggctaccctggccaagaaggcggaaaaggaaggctacgaagtgcgcatcctcaccgcggaccgggacctttaccagcttctttcggagcgaatctccatccttcacccggagggttacctgatcaccccggagtggctttgggagaagtatgggcttaagccttcccagtgggtggactaccgggccttggccggggacccttccgacaacatccccggcgtgaagggcatcggggagaagacggcggccaagctgatccgggagtggggaagcctggaaaaccttcttaagcacctggaacaggtgaaacctgcctccgtgcgggagaagatccttagccacatggaggacctcaagctatccctggagctatcccgggtgcacacggacttgctccttcaggtggacttcgcccggcgccgggagccggaccgggaggggcttaaggcctttttggagaggctggagttcggaagcctcctccacgagttcggcctgttggaaagcccggtggcggcggaggaagctccctggccgccccccgagggagccttcgtggggtacgttctttcccgccccgagcccatgtgggcggagcttaacgccttggccgccgcctgggagggaagggtttaccgggcggaggatcccttggaggccttgcgggggcttggggaggtgagggggcttttggccaaggacctggcggtgctggccctgagggaagggattgccctggcaccgggcgacgaccccatgctcctcgcctacctcctggatccttccaacaccgcccccgaaggggtagcccggcgctacgggggggagtggaccgaggaggcgggggaaagggcgctgctttccgaaaggctttacgccgccctcctgaagcggcttaagggggaggagaggcttctttggctttacgaggaggtggaaaagcccctttcgcgggtcctggcccacatggaggccacgggggtacggttggatgtggcctacttaaaggccctttccctggaggtggaggcggagataaggcgcttcgaggaggaggtccaccgcctggccgggcatcctttcaacctgaactcccgggaccagctggaaagggtcatctttgacgagcttgggcttcccgccatcggcaagacgcagaagacgggcaagcgctccaccagcgccgccgttttggaggccttgcgggaggctcatcccatcgtggaccgcatccttcagtaccgggagctttccaagctcaagggaacctacatcgatcccttgcctgccctggtccaccccaagacgaaccgcctccacacccgtttcaaccagacggccaccgccacggggaggcttagcagctcggatcctaatctgcaaaatatccccgtgcgcacccctttgggccagcggatccgccgggccttcgtggccgaggaggggtggaggctggtggttttggactacagccagattgagctcagggtcctggcgcacctttccggggacgagaacctaatccgggtcttccaggagggccaggacatccacacccagacggccagctggatgttcggcgtgcccccagaggccgtggattccctgatgcgccgggcggccaagaccatcaacttcggcgtcctctacggcatgtccgcccaccggctttcgggagagctggccatcccctacgaggaggcggtggccttcatcgagcggtatttccagagctaccccaaggtgcgggcctggattgagaaaaccctggcggaaggacgggaacggggctatgtggaaaccctctttggccgccggcgctacgtgcccgacttggcttcccgggtgaagagcatccgggaggcagcggagcgcatggccttcaacatgccggtccaggggaccgccgcggatttgatgaaactggccatggtgaagctctttcccaggcttcaggagctgggggccaggatgcttttgcaggtgcacaacgaactggtcctcgaggctcccaaggagcaagcggaggaagtcgcccaggaggccaagcggaccatggaggaggtgtggcccctgaaggtgcccttggaggtggaagtgggcatcggggaggactggctttccgccaaggcctag

SEQ ID NO: 132 - DNA, 2526 bp, Artificial Sequence
  Synthetic
atgaattccaccccactttttgacctggaggaaccccccaagcgggtgcttctggtggacggccaccacctggcctaccgcaccttctatgccctgagcctcaccacctcccggggggagccggtgcagatggtctacggcttcgcccggagcctcctcaaggccttgaaggaggacggacaggcggtggtcgtggtctttgacgccaaggccccctccttccgccacgaggcctacgaggcctacaaggcgggccgggcccccaccccggaggacttcccccgccagctcgccttggtcaagcggctggtggaccttctgggcctggtccgcctcgaggccccggggtacgaggcggacgacgtcctgggcaccctggccaagaaggccgaaagggaggggatggaggtgcgcatcctcacgggagaccgggacttcttccagctcctctccgagaaggtctcggtcctcctgccggacgggaccctggtcaccccaaaggacgtccaggagaagtacggggtgcccccggagcgctgggtggacttccgcgccctcacgggggaccgctcggacaacatccccggggtggcggggataggggagaagaccgcccttcgactcctcgcagagtgggggagcgtggaaaacctcctgaagaacctggaccgggtaaagccggactcgctccggcgcaagatagaggcgcacctcgaggacctccacctctccttagacctggcccgcatccgcaccgacctccccctggaggtggactttaaggccctgcgccgcaggacccccgacctggagggcctgagggcctttttggaggagctggagttcggaagcctcctccacgagttcggcctcctgggaggggagaagccccgggaggaggccccctggcccccgcccgaaggggccttcgtgggcttcctcctttcccgcaaggagcccatgtgggcggagcttctggccctggcggcggcctcgggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 133 - DNA, 2514 bp, Artificial Sequence
  Synthetic
atgaattccctgcccctctttgagcccaagggccgggtgcttctggtggacggccaccacctggcctaccgtaccttttttgccctgaagggcctcaccaccagccgcggggagccggtccaggcggtgtacgggtttgccaagagccttttgaaggcgctaagggaagacggggatgtggtgatcgtggtgtttgacgccaaggccccctccttccgccaccagacctacgaggcctacaaggcggggcgggctcccacccccgaggactttccccggcagcttgcccttatcaaggagatggtggaccttttgggcctggagcgcctcgaggtgccgggctttgaagcggatgacgtcctggctaccctggccaagaaggcggaaaaggaaggctacgaagtgcgcatcctcaccgcggaccgggacctttaccagcttctttcggagcgaatctccatccttcacccggagggttacctgatcaccccggagtggctttgggagaagtatgggcttaagccttcccagtgggtggactaccgggccttggccggggacccttccgacaacatccccggcgtgaagggcatcggggagaagacggcggccaagctgatccgggagtggggaagcctggaaaaccttcttaagcacctggaacaggtgaaacctgcctccgtgcgggagaagatccttagccacatggaggacctcaagctatccctggagctatcccgggtgcacacggacttgctccttcaggtggacttcgcccggcgccgggagccggaccgggaggggcttaaggcctttttggagaggctggagttcggaagcctcctccacgagttcggcctgttggaaagcccggtggcggcggaggaagctccctggccgccccccgagggagccttcgtggggtacgttctttcccgccccgagcccatgtgggcggagcttaacgccttggccgccgcctggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 134 - DNA, 2526 bp, Artificial Sequence
  Synthetic
atgaattccaccccactttttgacctggaggaaccccccaagcgggtgcttctggtggacggccaccacctggcctaccgcaccttctatgccctgagcctcaccacctcccggggggagccggtgcagatggtctacggcttcgcccggagcctcctcaaggccttgaaggaggacggacaggcggtggtcgtggtctttgacgccaaggccccctccttccgccacgaggcctacgaggcctacaaggcgggccgggcccccaccccggaggacttcccccgccagctcgccttggtcaagcggctggtggaccttctgggcctggtccgcctcgaggccccggggtacgaggcggacgacgtcctgggcaccctggccaagaaggccgaaagggaggggatggaggtgcgcatcctcacgggagaccgggacttcttccagctcctctccgagaaggtctcggtcctcctgccggacgggaccctggtcaccccaaaggacgtccaggagaagtacggggtgcccccggagcgctgggtggacttccgcgccctcacgggggaccgctcggacaacatccccggggtggcggggataggggagaagaccgcccttcgactcctcgcagagtgggggagcgtggaaaacctcctgaagaacctggaccgggtaaagccggactcgctccggcgcaagatagaggcgcacctcgaggacctccacctctccttagacctggcccgcatccgcaccgacctccccctggaggtggactttaaggccctgcgccgcaggacccccgacctggagggcctgagggcctttttggaggagctggagttcggaagcctcctccacgagttcggcctcctgggaggggagaagccccgggaggaggccccctggcccccgcccgaaggggccttcgtgggcttcctcctttcccgcaaggagcccatgtgggcggagcttctggccctggcggcggcctcgggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcaagaagacgcaaaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 135 - DNA, 2514 bp, Artificial Sequence
  Synthetic
atgaattccctgcccctctttgagcccaagggccgggtgcttctggtggacggccaccacctggcctaccgtaccttttttgccctgaagggcctcaccaccagccgcggggagccggtccaggcggtgtacgggtttgccaagagccttttgaaggcgctaagggaagacggggatgtggtgatcgtggtgtttgacgccaaggccccctccttccgccaccagacctacgaggcctacaaggcggggcgggctcccacccccgaggactttccccggcagcttgcccttatcaaggagatggtggaccttttgggcctggagcgcctcgaggtgccgggctttgaagcggatgacgtcctggctaccctggccaagaaggcggaaaaggaaggctacgaagtgcgcatcctcaccgcggaccgggacctttaccagcttctttcggagcgaatctccatccttcacccggagggttacctgatcaccccggagtggctttgggagaagtatgggcttaagccttcccagtgggtggactaccgggccttggccggggacccttccgacaacatccccggcgtgaagggcatcggggagaagacggcggccaagctgatccgggagtggggaagcctggaaaaccttcttaagcacctggaacaggtgaaacctgcctccgtgcgggagaagatccttagccacatggaggacctcaagctatccctggagctatcccgggtgcacacggacttgctccttcaggtggacttcgcccggcgccgggagccggaccgggaggggcttaaggcctttttggagaggctggagttcggaagcctcctccacgagttcggcctgttggaaagcccggtggcggcggaggaagctccctggccgccccccgagggagccttcgtggggtacgttctttcccgccccgagcccatgtgggcggagcttaacgccttggccgccgcctggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcaagaagacgcaaaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 136 - protein, 320 aa, Artificial Sequence
  Synthetic
MASMTGGQQMGRINSGMLPLFEPKGRVLLVDGHHLAYRTFHALKGLTTSRGEPVQAVYGFAKSLLKALKEDGDAVIVVFDAKAPSFRHEAYGGYKAGRAPTLVPRGSEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKAALEHHHHHH

SEQ ID NO: 137 - DNA, 73 bp, Artificial Sequence
  Synthetic
ccctatctttaaagtttttaaaaagtttgacccccttttgggggccctatctttaaagtttttaaaaatttga

SEQ ID NO: 138 - DNA, 15 bp, Artificial Sequence
  Synthetic
cgcgcggaacgcgcg

SEQ ID NO: 139 - DNA, 16 bp, Artificial Sequence
  Synthetic
cccgggttttcccggg

SEQ ID NO: 140 - DNA, 20 bp, Artificial Sequence
  Synthetic
aggcgcaccaatttggtgtt

SEQ ID NO: 141 - RNA, 53 nt, Artificial Sequence
  Synthetic
uucgcuuucuucccuuccuuucucgccacguucgccggcuuuccccgucaagc

SEQ ID NO: 142 - DNA, 30 bp, Artificial Sequence
  Synthetic
acggggaaagccggcgaacgtggcgagaaa

SEQ ID NO: 143 - DNA, 26 bp, Artificial Sequence
  Synthetic
attagaaaggaagggaagaaagcgaa

SEQ ID NO: 144 - DNA, 30 bp, Artificial Sequence
  Synthetic
acggggaaagccggcgaacgtggcgagaac

SEQ ID NO: 145 - DNA, 30 bp, Artificial Sequence
  Synthetic
cttgacggggaaagccggcgaacgtggcgc

SEQ ID NO: 146 - DNA, 23 bp, Artificial Sequence
  Synthetic
agaaaggaagggaagaaagcgaa

SEQ ID NO: 147 - DNA, 63 bp, Artificial Sequence
  Synthetic
gcgcggcggcgggtgtggtggttacgcgcagcgtgaccgctacacttgccagcgccctagcgc

SEQ ID NO: 148 - DNA, 30 bp, Artificial Sequence
  Synthetic
gcgctagggcgctggcaagtgtagcggtca

SEQ ID NO: 149 - DNA, 35 bp, Artificial Sequence
  Synthetic
gatcgctgcgcgtaaccaccacacccgcgccgcgc

SEQ ID NO: 150 - DNA, 30 bp, Artificial Sequence
  Synthetic
ggactctgcctcaagacggtagtcaacgtg

SEQ ID NO: 151 - DNA, 16 bp, Artificial Sequence
  Synthetic
cacgttgactaccgtc

SEQ ID NO: 152 - DNA, 34 bp, Artificial Sequence
  Synthetic
catgtcaagcagtcctaactttgaggcagagtcc

SEQ ID NO: 153 - DNA, 2506 bp, Thermus aquaticus
atgagggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccagggggggccgggtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttccaacaccacccccgagggggtggcccggcgctacggcggggagtggacggaggaggcgggggagcgggccgccctttccgagaggctcttcgccaacctgtgggggaggcttgagggggaggagaggctcctttggctttaccgggaggtggagaggcccctttccgctgtcctggcccacatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacgacgagctggtcctcgaggccccaaaagagagggcggaggccgtggcccggctggccaaggaggtcatggagggggtgtatcccctggccgtgcccctggaggtggaggtggggataggggaggactggctctccgccaaggagtgataccacc

SEQ ID NO: 154 - DNA, 2496 bp, Thermus flavus
atggcgatgcttcccctctttgagcccaaaggccgcgtgctcctggtggacggccaccacctggcctaccgcaccttctttgccctcaagggcctcaccaccagccgcggcgaacccgttcaggcggtctacggcttcgccaaaagcctcctcaaggccctgaaggaggacggggacgtggtggtggtggtctttgacgccaaggccccctccttccgccacgaggcctacgaggcctacaaggcgggccgggcccccaccccggaggactttccccggcagctggccctcatcaaggagttggtggacctcctaggccttgtgcggctggaggttcccggctttgaggcggacgacgtgctggccaccctggccaagcgggcggaaaaggaggggtacgaggtgcgcatcctcactgccgaccgcgacctctaccagctcctttcggagcgcatcgccatcctccaccctgaggggtacctgatcaccccggcgtggctttacgagaagtacggcctgcgcccggagcagtgggtggactaccgggccctggcgggggacccctcggataacatccccggggtgaagggcatcggggagaagaccgcccagaggctcatccgcgagtgggggagcctggaaaacctcttccagcacctggaccaggtgaagccctccttgcgggagaagctccaggcgggcatggaggccctggccctttcccggaagctttcccaggtgcacactgacctgcccctggaggtggacttcgggaggcgccgcacacccaacctggagggtctgcgggcttttttggagcggttggagtttggaagcctcctccacgagttcggcctcctggaggggccgaaggcggcagaggaggccccctggccccctccggaaggggcttttttgggcttttccttttcccgtcccgagcccatgtgggccgagcttctggccctggctggggcgtgggaggggcgcctccatcgggcacaagacccccttaggggcctgagggaccttaagggggtgcggggaatcctggccaaggacctggcggttttggccctgcgggagggcctggacctcttcccagaggacgaccccatgctcctggcctaccttctggacccctccaacaccacccctgagggggtggcccggcgttacgggggggagtggacggaggatgcgggggagagggccctcctggccgagcgcctcttccagaccctaaaggagcgccttaagggagaagaacgcctgctttggctttacgaggaggtggagaagccgctttcccgggtgttggcccggatggaggccacgggggtccggctggacgtggcctacctccaggccctctccctggaggtggaggcggaggtgcgccagctggaggaggaggtcttccgcctggccggccaccccttcaacctcaactcccgcgaccagctggagcgggtgctctttgacgagctgggcctgcctgccatcggcaagacggagaagacggggaaacgctccaccagcgctgccgtgctggaggccctgcgagaggcccaccccatcgtggaccgcatcctgcagtaccgggagctcaccaagctcaagaacacctacatagaccccctgcccgccctggtccaccccaagaccggccggctccacacccgcttcaaccagacggccaccgccacgggcaggctttccagctccgaccccaacctgcagaacatccccgtgcgcacccctctgggccagcgcatccgccgagccttcgtggccgaggagggctgggtgctggtggtcttggactacagccagattgagcttcgggtcctggcccacctctccggggacgagaacctgatccgggtctttcaggaggggagggacatccacacccagaccgccagctggatgttcggcgtttcccccgaaggggtagaccctctgatgcgccgggcggccaagaccatcaacttcggggtgctctacggcatgtccgcccaccgcctctccggggagctttccatcccctacgaggaggcggtggccttcattgagcgctacttccagagctaccccaaggtgcgggcctggattgaggggaccctcgaggagggccgccggcgggggtatgtggagaccctcttcggccgccggcgctatgtgcccgacctcaacgcccgggtgaagagcgtgcgcgaggcggcggagcgcatggccttcaacatgccggtccagggcaccgccgccgacctcatgaagctggccatggtgcggcttttcccccggcttcaggaactgggggcgaggatgcttttgcaggtgcacgacgagctggtcctcgaggcccccaaggaccgggcggagagggtagccgctttggccaaggaggtcatggagggggtctggcccctgcaggtgcccctggaggtggaggtgggcctgggggaggactggctctccgccaaggagtag

SEQ ID NO: 155 - DNA, 2505 bp, Thermus thermophilus
atggaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcagggacggccgggtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccctccaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccacatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtccacgacgagctcctcctggaggccccccaagcgcgggccgaggaggtggcggctttggccaaggaggccatggagaaggcctatcccctcgccgtgcccctggaggtggaggtggggatgggggaggactggctttccgccaagggttag

SEQ ID NO: 156 - DNA, 2502 bp, Artificial Sequence
  Synthetic
  misc_feature (4)..(5): n is any of the bases g, a, t, or c.
  misc_feature (181)..(182): n is any of the bases g, a, t, or c.
  misc_feature (190)..(190): n is any of the bases g, a, t, or c.
  misc_feature (366)..(366): n is any of the bases g, a, t, or c.
  misc_feature (617)..(617): n is any of the bases g, a, t, or c.
  misc_feature (628)..(628): n is any of the bases g, a, t, or c.
  misc_feature (685)..(685): n is any of the bases g, a, t, or c.
  misc_feature (714)..(714): n is any of the bases g, a, t, or c.
  misc_feature (722)..(722): n is any of the bases g, a, t, or c.
  misc_feature (738)..(738): n is any of the bases g, a, t, or c.
  misc_feature (784)..(784): n is any of the bases g, a, t, or c.
  misc_feature (1022)..(1022): n is any of the bases g, a, t, or c.
  misc_feature (1029)..(1029): n is any of the bases g, a, t, or c.
  misc_feature (1038)..(1038): n is any of the bases g, a, t, or c.
  misc_feature (1053)..(1053): n is any of the bases g, a, t, or c.
  misc_feature (1098)..(1098): n is any of the bases g, a, t, or c.
  misc_feature (1105)..(1105): n is any of the bases g, a, t, or c.
  misc_feature (1206)..(1206): n is any of the bases g, a, t, or c.
  misc_feature (1227)..(1227): n is any of the bases g, a, t, or c.
  misc_feature (1244)..(1244): n is any of the bases g, a, t, or c.
  misc_feature (1251)..(1253): n is any of the bases g, a, t, or c.
  misc_feature (1350)..(1350): n is any of the bases g, a, t, or c.
  misc_feature (1380)..(1380): n is any of the bases g, a, t, or c.
  misc_feature (1497)..(1497): n is any of the bases g, a, t, or c.
  misc_feature (1530)..(1530): n is any of the bases g, a, t, or c.
  misc_feature (1569)..(1569): n is any of the bases g, a, t, or c.
  misc_feature (1572)..(1572): n is any of the bases g, a, t, or c.
  misc_feature (1641)..(1641): n is any of the bases g, a, t, or c.
  misc_feature (1653)..(1653): n is any of the bases g, a, t, or c.
  misc_feature (1655)..(1655): n is any of the bases g, a, t, or c.
  misc_feature (1770)..(1770): n is any of the bases g, a, t, or c.
  misc_feature (1812)..(1812): n is any of the bases g, a, t, or c.
  misc_feature (2319)..(2319): n is any of the bases g, a, t, or c.
  misc_feature (2346)..(2346): n is any of the bases g, a, t, or c.
  misc_feature (2396)..(2396)
  misc_feature (2396)..(2396): n is any of the bases g, a, t, or c.
atgnnggcgatgcttcccctctttgagcccaaaggccgggtcctcctggtggacggccaccacctggcctaccgcaccttcttcgccctgaagggcctcaccaccagccggggcgaaccggtgcaggcggtctacggcttcgccaagagcctcctcaaggccctgaaggaggacggggacnnggcggtgntcgtggtctttgacgccaaggccccctccttccgccacgaggcctacgaggcctacaaggcgggccgggcccccaccccggaggactttccccggcagctcgccctcatcaaggagctggtggacctcctggggcttgcgcgcctcgaggtccccggctacgaggcggacgacgtnctggccaccctggccaagaaggcggaaaaggaggggtacgaggtgcgcatcctcaccgccgaccgcgacctctaccagctcctttccgaccgcatcgccgtcctccaccccgaggggtacctcatcaccccggcgtggctttgggagaagtacggcctgaggccggagcagtgggtggactaccgggccctggcgggggacccctccgacaacctccccggggtcaagggcatcggggagaagaccgcccngaagctcctcnaggagtgggggagcctggaaaacctcctcaagaacctggaccgggtgaagcccgccntccgggagaagatccaggcccacatggangacctgangctctcctgggagctntcccaggtgcgcaccgacctgcccctggaggtggacttcgccaagnggcgggagcccgaccgggaggggcttagggcctttctggagaggctggagtttggcagcctcctccacgagttcggcctcctggagggccccaaggccctggaggaggccccctggcccccgccggaaggggccttcgtgggctttgtcctttcccgccccgagcccatgtgggccgagcttctggccctggccgccgccagggagggccgggtccaccgggcaccagacccctttangggcctnagggacctnaaggaggtgcggggnctcctcgccaaggacctggccgttttggccctgagggagggcctngacctcntgcccggggacgaccccatgctcctcgcctacctcctggacccctccaacaccacccccgagggggtggcccggcgctacgggggggagtggacggaggangcgggggagcgggccctcctntccgagaggctcttccngaacctnnngcagcgccttgagggggaggagaggctcctttggctttaccaggaggtggagaagcccctttcccgggtcctggcccacatggaggccacgggggtncggctggacgtggcctacctccaggccctntccctggaggtggcggaggagatccgccgcctcgaggaggaggtcttccgcctggccggccaccccttcaacctcaactcccgggaccagctggaaagggtgctctttgacgagctngggcttcccgccatcggcaagacggagaagacnggcaagcgctccaccagcgccgccgtgctggaggccctncgngaggcccaccccatcgtggagaagatcctgcagtaccgggagctcaccaagctcaagaacacctacatngaccccctgccngncctcgtccaccccaggacgggccgcctccacacccgcttcaaccagacggccacggccacgggcaggcttagtagctccgaccccaacctgcagaacatccccgtccgcaccccnctgggccagaggatccgccgggccttcgtggccgaggagggntgggtgttggtggccctggactatagccagatagagctccgggtcctggcccacctctccggggacgagaacctgatccgggtcttccaggaggggagggacatccacacccagaccgccagctggatgttcggcgtccccccggaggccgtggaccccctgatgcgccgggcggccaagaccatcaacttcggggtcctctacggcatgtccgcccaccgcctctcccaggagcttgccatcccctacgaggaggcggtggccttcattgagcgctacttccagagcttccccaaggtgcgggcctggattgagaagaccctggaggagggcaggaggcgggggtacgtggagaccctcttcggccgccggcgctacgtgcccgacctcaacgcccgggtgaagagcgtgcgggaggcggcggagcgcatggccttcaacatgcccgtccagggcaccgccgccgacctcatgaagctggccatggtgaagctcttcccccggctncaggaaatgggggccaggatgctcctncaggtccacgacgagctggtcctcgaggcccccaaagagcgggcggaggnggtggccgctttggccaaggaggtcatggagggggtctatcccctggccgtgcccctggaggtggaggtggggatgggggaggactggctctccgccaaggagtag

SEQ ID NO: 157 - protein, 832 aa, Thermus aquaticus [sequence omitted]

SEQ ID NO: 158 - protein, 831 aa, Thermus flavus
MAMLPLFEPKGRVLLVDGHHLAYRTFFALKGLTTSRGEPVQAVYGFAKSLLKALKEDGDVVVVVFDAKAPSFRHEAYEAYKAGRAPTPEDFPRQLALIKELVDLLGLVRLEVPGFEADDVLATLAKRAEKEGYEVRILTADRDLYQLLSERIAILHPEGYLITPAWLYEKYGLRPEQWVDYRALAGDPSDNIPGVKGIGEKTAQRLIREWGSLENLFQHLDQVKPSLREKLQAGMEALALSRKLSQVHTDLPLEVDFGRRRTPNLEGLRAFLERLEFGSLLHEFGLLEGPKAAEEAPWPPPEGAFLGFSFSRPEPMWAELLALAGAWEGRLHRAQDPLRGLRDLKGVRGILAKDLAVLALREGLDLFPEDDPMLLAYLLDPSNTTPEGVARRYGGEWTEDAGERALLAERLFQTLKERLKGEERLLWLYEEVEKPLSRVLARMEATGVRLDVAYLQALSLEVEAEVRQLEEEVFRLAGHPFNLNSRDQLERVLFDELGLPAIGKTEKTGKRSTSAAVLEALREAHPIVDRILQYRELTKLKNTYIDPLPALVHPKTGRLHTRFNQTATATGRLSSSDPNLQNIPVRTPLGQRIRRAFVAEEGWVLVVLDYSQIELRVLAHLSGDENLIRVFQEGRDIHTQTASWMFGVSPEGVDPLMRRAAKTINFGVLYGMSAHRLSGELSIPYEEAVAFIERYFQSYPKVRAWIEGTLEEGRRRGYVETLFGRRRYVPDLNARVKSVREAAERMAFNMPVQGTAADLMKLAMVRLFPRLQELGARMLLQVHDELVLEAPKDRAERVAALAKEVMEGVWPLQVPLEVEVGLGEDWLSAKE

SEQ ID NO: 159 - protein, 833 aa, Artificial Sequence
  Synthetic
  MISC_FEATURE (2)..(2): X is any amino acid.
  MISC_FEATURE (63)..(63): X is any amino acid.
  MISC_FEATURE (109)..(109): X is any amino acid.
  MISC_FEATURE (186)..(186): X is any amino acid.
  MISC_FEATURE (205)..(205): X is any amino acid.
  MISC_FEATURE (209)..(209): X is any amino acid.
  MISC_FEATURE (227)..(228): X is any amino acid.
  MISC_FEATURE (233)..(233): X is any amino acid.
  MISC_FEATURE (240)..(240): X is any amino acid.
  MISC_FEATURE (243)..(244): X is any amino acid.
  MISC_FEATURE (247)..(247): X is any amino acid.
  MISC_FEATURE (260)..(260): X is any amino acid.
  MISC_FEATURE (290)..(290): X is any amino acid.
  MISC_FEATURE (329)..(329): X is any amino acid.
  MISC_FEATURE (336)..(336): X is any amino acid.
  MISC_FEATURE (340)..(340): X is any amino acid.
  MISC_FEATURE (368)..(368): X is any amino acid.
  MISC_FEATURE (414)..(414): X is any amino acid.
  MISC_FEATURE (417)..(418): X is any amino acid.
  MISC_FEATURE (431)..(431): X is any amino acid.
  MISC_FEATURE (551)..(551): X is any amino acid.
  MISC_FEATURE (605)..(605): X is any amino acid.
  MISC_FEATURE (773)..(773): X is any amino acid.
  MISC_FEATURE (794)..(794): X is any amino acid.
  MISC_FEATURE (798)..(798): X is any amino acid.
  MISC_FEATURE (823)..(823): X is any amino acid.
  MISC_FEATURE (833)..(833): X is any amino acid.
MXAMLPLFEPKGRVLLVDGHHLAYRTFFALKGLTTSRGEPVQAVYGFAKSLLKALKEDGDAVXVVFDAKAPSFRHEAYEAYKAGRAPTPEDFPRQLALIKELVDLLGLXRLEVPGYEADDVLATLAKKAEKEGYEVRILTADRDLYQLLSDRIAVLHPEGYLITPAWLWEKYGLRPEQWVDYRALXGDPSDNLPGVKGIGEKTAXKLLXEWGSLENLLKNLDRVKPXXREKIXAHMEDLXLSXXLSXVRTDLPLEVDFAXRREPDREGLRAFLERLEFGSLLHEFGLLEXPKALEEAPWPPPEGAFVGFVLSRPEPMWAELLALAAARXGRVHRAXDPLXGLRDLKEVRGLLAKDLAVLALREGLDLXPGDDPMLLAYLLDPSNTTPEGVARRYGGEWTEDAGERALLSERLFXNLXXRLEGEERLLWLYXEVEKPLSRVLAHMEATGVRLDVAYLQALSLEVAEEIRRLEEEVFRLAGHPFNLNSRDQLERVLFDELGLPAIGKTEKTGKRSTSAAVLEALREAHPIVEKILQYRELTKLKNTYIDPLPXLVHPRTGRLHTRFNQTATATGRLSSSDPNLQNIPVRTPLGQRIRRAFVAEEGWXLVALDYSQIELRVLAHLSGDENLIRVFQEGRDIHTQTASWMFGVPPEAVDPLMRRAAKTINFGVLYGMSAHRLSQELAIPYEEAVAFIERYFQSFPKVRAWIEKTLEEGRRRGYVETLFGRRRYVPDLNARVKSVREAAERMAFNMPVQGTAADLMKLAMVKLFPRLXEMGARMLLQVHDELVLEAPKXRAEXVAALAKEVMEGVYPLAVPLEVEVGXGEDWLSAKEX

SEQ ID NO: 160 - RNA, 640 nt, Artificial Sequence
  Synthetic
gggagcccagcuaugaacuccuucuccacaagcgccuucgguccaguugccuucucccuggggcugcuccugguguugccugcugccuucccugccccaguacccccaggagaagauuccaaagauguagccgccccacacagacagccacucaccucuucagaacgaauugacaaacaaauucgguacauccucgacggcaucucagcccugagaaaggagacauguaacaagaguaacaugugugaaagcagcaaagaggcacuggcagaaaacaaccugaaccuuccaaagauggcugaaaaagauggaugcuuccaaucuggauucaaugaggagacuugccuggugaaaaucaucacuggucuuuuggaguuugagguauaccuagaguaccuccagaacagauuugagaguagugaggaacaagccagagcuguccagaugaguacaaaaguccugauccaguuccugcagaaaaaggcaaagaaucuagaugcaauaaccaccccugacccaaccacaaaugccagccugcugacgaagcugcaggcacagaaccaguggcugcaggacaugacaacucaucucauucugcgcagcuuuaaggaguuccugcaguccagccugagggcucuuc

SEQ ID NO: 161 - DNA, 27 bp, Artificial Sequence
  Synthetic
agggagaaggcaactggaccgaaggcc

SEQ ID NO: 162 - DNA, 35 bp, Artificial Sequence
  Synthetic
  misc_feature (1)..(1): TH 5' end has a fluorescein label.
  misc_feature (35)..(35): TH 3' end is modified with a dideoxynucleotide.
ncgaaattaatacgcttgtggagaaggagttcatn

SEQ ID NO: 163 - DNA, 53 bp, Artificial Sequence
  Synthetic
gctatgaactccttctccacaagcgccttcggtccagttgccttctccctggg

SEQ ID NO: 164 - protein, 214 aa, Artificial Sequence
  Synthetic
DPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRI

SEQ ID NO: 165 - protein, 214 aa, Artificial Sequence
  Synthetic
DPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRI

SEQ ID NO: 166 - RNA, 37 nt, Artificial Sequence
  Synthetic
  misc_feature (1)..(1): TH 5' end is modified with a biotin-streptavitin complex.
nucacggcaguuggugcgccucggaacgaggcgcacg

SEQ ID NO: 167 - DNA, 17 bp, Artificial Sequence
  Synthetic
  misc_feature (1)..(1): TH 5' end is labeled with tetrachlororfluorescein.
nttttcaactgccgtga

SEQ ID NO: 168 - DNA, 36 bp, Artificial Sequence
  Synthetic
tcacggcagttggtgcgcctcggaacgaggcgcacg

SEQ ID NO: 169 - DNA, 30 bp, Artificial Sequence
  Synthetic
cgccgagatcacctttacattttctatcgt

SEQ ID NO: 170 - DNA, 24 bp, Artificial Sequence
  Synthetic
ccttccttatcctggatcttggca

SEQ ID NO: 171 - DNA, 24 bp, Artificial Sequence
  Synthetic
acgatagaaaatgtaaaggtgatc

SEQ ID NO: 172 - DNA, 15 bp, Artificial Sequence
  Synthetic
  misc_feature (4)..(4): The residue at this position is a z28 linker group.
ctcnttctcagtgcg

SEQ ID NO: 173 - DNA, 29 bp, Artificial Sequence
  Synthetic
cgcagtgagaatgaggtgatctcggcggt

SEQ ID NO: 174 - DNA, 31 bp, Artificial Sequence
  Synthetic
ccgccgagatcacggatgttgtaatcagaga

SEQ ID NO: 175 - DNA, 21 bp, Artificial Sequence
  Synthetic
gtgcagggttgactccttctc

SEQ ID NO: 176 - DNA, 21 bp, Artificial Sequence
  Synthetic
gtgcagggttgactctttctc

SEQ ID NO: 177 - DNA, 21 bp, Artificial Sequence
  Synthetic
gtgcagggtcgactctttctc

SEQ ID NO: 178 - DNA, 25 bp, Artificial Sequence
  Synthetic
tctctgattacaacatccgtgatct

SEQ ID NO: 179 - DNA, 29 bp, Artificial Sequence
  Synthetic
cgccgagatcacgtagttgaggtcaatga

SEQ ID NO: 180 - DNA, 27 bp, Artificial Sequence
  Synthetic
gaatcatactggaacatgtagaccatc

SEQ ID NO: 181 - DNA, 24 bp, Artificial Sequence
  Synthetic
tcattgacctcaactacgtgatct

SEQ ID NO: 182 - DNA, 28 bp, Artificial Sequence
  Synthetic
ccgccgagatcacgatgatcttgaggct

SEQ ID NO: 183 - DNA, 20 bp, Artificial Sequence
  Synthetic
tggtgcaggaggcattgctc

SEQ ID NO: 184 - DNA, 23 bp, Artificial Sequence
  Synthetic
cagcctcaagattaccgtgatct

SEQ ID NO: 185 - DNA, 23 bp, Artificial Sequence
  Synthetic
ccgtcacgcctcctccacggctc

SEQ ID NO: 186 - DNA, 23 bp, Artificial Sequence
  Synthetic
aggcgaaagccctcaatttccca

SEQ ID NO: 187 - DNA, 15 bp, Artificial Sequence
  Synthetic
aaccactgccgcaca

SEQ ID NO: 188 - DNA, 17 bp, Artificial Sequence
  Synthetic
gagccgtggaggaggcg

SEQ ID NO: 189 - DNA, 14 bp, Artificial Sequence
  Synthetic
  misc_feature (4)..(4): The residue at this position is a z28 linker group.
cacntgcttcgtgg

SEQ ID NO: 190 - DNA, 27 bp, Artificial Sequence
  Synthetic
ccaggaagcaagtggaggcgtgacggt

SEQ ID NO: 191 - DNA, 26 bp, Artificial Sequence
  Synthetic
ccgtcacgcctccttcggagtttggg

SEQ ID NO: 192 - DNA, 25 bp, Artificial Sequence
  Synthetic
gggttgtggagtgagtgttcaagta

SEQ ID NO: 193 - DNA, 20 bp, Artificial Sequence
  Synthetic
gggaaactccgaaggaggcg

SEQ ID NO: 194 - DNA, 23 bp, Artificial Sequence
  Synthetic
ccgtcacgcctctctgactgcca

SEQ ID NO: 195 - DNA, 27 bp, Artificial Sequence
  Synthetic
ttgtcactcggggttcgagaagatgaa

SEQ ID NO: 196 - DNA, 11 bp, Artificial Sequence
  Synthetic
gggccagaggg

SEQ ID NO: 197 - DNA, 17 bp, Artificial Sequence
  Synthetic
aggcagtcagagaggcg

SEQ ID NO: 198 - DNA, 26 bp, Artificial Sequence
  Synthetic
ccgtcacgcctcctcctcattgaatt

SEQ ID NO: 199 - DNA, 35 bp, Artificial Sequence
  Synthetic
ccaaaagtccagtgatgattttcaccaggcaagta

SEQ ID NO: 200 - DNA, 20 bp, Artificial Sequence
  Synthetic
cagattggaagcatccatct

SEQ ID NO: 201 - DNA, 19 bp, Artificial Sequence
  Synthetic
gattcaatgaggaggaggc

SEQ ID NO: 202 - DNA, 24 bp, Artificial Sequence
  Synthetic
ccgtcacgcctccatctgtttagg

SEQ ID NO: 203 - DNA, 22 bp, Artificial Sequence
  Synthetic
caggtcctggaaggagcactta

SEQ ID NO: 204 - DNA, 27 bp, Artificial Sequence
  Synthetic
gccatcagcttctttgttcttgtcatc

SEQ ID NO: 205 - DNA, 20 bp, Artificial Sequence
  Synthetic
gccctaaacagatggaggcg

SEQ ID NO: 206 - DNA, 24 bp, Artificial Sequence
  Synthetic
ccgtcacgcctcctccagttgtag

SEQ ID NO: 207 - DNA, 30 bp, Artificial Sequence
  Synthetic
aaaatcatctgtaaatccagcagtaaatga

SEQ ID NO: 208 - DNA, 20 bp, Artificial Sequence
  Synthetic
ctgtgttttctttgtagaac

SEQ ID NO: 209 - DNA, 17 bp, Artificial Sequence
  Synthetic
ctacaactggaggaggc

SEQ ID NO: 210 - DNA, 23 bp, Artificial Sequence
  Synthetic
ccgtcacgcctcctctcagttct

SEQ ID NO: 211 - DNA, 21 bp, Artificial Sequence
  Synthetic
gtgtggtccactctcaatcaa

SEQ ID NO: 212 - DNA, 26 bp, Artificial Sequence
  Synthetic
  modified_base (1)..(1): The residue at tH position contains a TET-label.
attagaaaggaagggaagaaagcgaa

SEQ ID NO: 213 - DNA, 30 bp, Artificial Sequence
  Synthetic
gcttgacggggaaagccggcgaacgtggcg

SEQ ID NO: 214 - DNA, 30 bp, Artificial Sequence
  Synthetic
cttgacggggaaagccggcgaacgtggcga

SEQ ID NO: 215 - DNA, 30 bp, Artificial Sequence
  Synthetic
tgacggggaaagccggcgaacgtggcgaga

SEQ ID NO: 216 - DNA, 30 bp, Artificial Sequence; identical to SEQ ID NO: 142
  Synthetic

SEQ ID NO: 217 - DNA, 53 bp, Artificial Sequence
  Synthetic
ttcgctttcttcccttcctttctcgccacgttcgccggctttccccgtcaagc

SEQ ID NO: 218 - DNA, 18 bp, Artificial Sequence
  Synthetic
  modified_base (1)..(1): The residue at tH positions contains a fluoroscein label.
tttccctcctcctcttcc

SEQ ID NO: 219 - DNA, 30 bp, Artificial Sequence
  Synthetic
acacagtgtcctcccgctcctcctgagcaa

SEQ ID NO: 220 - DNA, 54 bp, Artificial Sequence
  Synthetic
atgaggaagaggaggagggtgctcaggaggagcgggaggacactgtgtctgtca

SEQ ID NO: 221 - protein, 840 aa, Artificial Sequence
  Synthetic
MNSEAMLPLFEPKGRVLLVDGHHLAYRTFFALKGLTTSRGEPVQAVYGFAKSLLKALREDGDAVIVVFDAEAPSFRHEAYGGYKAGRAPTPEDFPRQLALIKELVDLLGFTRLEVPGYEADDVLATLAKKAEKEGYEVRILTADKDLYQLLSDRIHVLHPEGYLITPAWLWEKYGLRPDQWADYRALTGDESDNLPGVKGIGEKTALKLLKEWGSLEALLKNLDRLKPAIREKILAHMDDLKLSWDLAKVRTDLPLEVDFAKRREPDREGLKAFLERLEFGSLLHEFGLLGGEKPREEAPWPPPEGAFVGFVLSRKEPMWADLLALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 222 - DNA, 2520 bp, Artificial Sequence
  Synthetic
atgaattccgaggcgatgcttccgctctttgaacccaaaggccgggtcctcctggtggacggccaccacctggcctaccgtaccttttttgccctgaagggcctcaccaccagccggggggagccggtccaggcggtgtacgggtttgccaagagccttttgaaggcgctaagagaagacggggacgcggtgatcgtggtctttgacgccgaggccccctccttccgccacgaggcctacggggggtacaaggcggggcgggctcccacccccgaggactttccccggcagcttgcccttatcaaggagctggtggacctcctggggtttacccgcctcgaggtccccggctacgaggcggacgacgttctcgccaccctggccaagaaggcggaaaaggaggggtacgaggtgcgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagaccgccctcaagctcctcaaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggaggggcttaaggcctttttggagaggctggagttcggcagcctcctccacgagttcggcctcctgggaggggagaagccccgggaggaggccccctggcccccgccggaaggggccttcgtgggctttgtgctttcccgcaaggagcccatgtgggccgatcttctggccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 223 - DNA, 16 bp, Artificial Sequence
  Synthetic
  misc_feature (1)..(1): TH 5' end has a fluorescein label.
  misc_feature (6)..(6): The residue at tH position is a cy3 abasic linker group.
ncgctntctcgctcgc

SEQ ID NO: 224 - DNA, 18 bp, Artificial Sequence
  Synthetic
acggaacgagcgtctttg

SEQ ID NO: 225 - RNA, 32 nt, Artificial Sequence
  Synthetic
gcgagcgagacagcgaaagacgcucguuccgu

SEQ ID NO: 226 - DNA, 32 bp, Artificial Sequence
  Synthetic
gcgagcgagacagcgaaagacgctcgttccgt

SEQ ID NO: 227 - DNA, 29 bp, Artificial Sequence
  Synthetic
acggaacgagcgtctttcatctgtcaatc

SEQ ID NO: 228 - RNA, 26 nt, Artificial Sequence
  Synthetic
ucacggcaguuggugcggaacgcacg

SEQ ID NO: 229 - DNA, 26 bp, Artificial Sequence
  Synthetic
tcacggcagttggtgcggaacgcacg

SEQ ID NO: 230 - DNA, 30 bp, Artificial Sequence
  Synthetic
  misc_feature (30)..(30): TH 3' end is modified with an amine moiety.
cggaggaagcagttggtgcgcctcgttaan

SEQ ID NO: 231 - DNA, 23 bp, Artificial Sequence
  Synthetic
  misc_feature (1)..(1): TH 5' end is labeled with fluorescein.
ntccttctcaactgcttcctccg

SEQ ID NO: 232 - DNA, 28 bp, Artificial Sequence
  Synthetic
  misc_feature (28)..(28): TH 3' end is modified with a biotin moiety.
aacgaggcgcacctcaaatctccctttn

SEQ ID NO: 233 - DNA, 26 bp, Artificial Sequence
  Synthetic
  misc_feature (1)..(1): TH 5' end is labeled with fluorescein.
nagcgagacagcgaaagacgctcgtt

SEQ ID NO: 234 - DNA, 17 bp, Artificial Sequence
  Synthetic
  misc_feature (1)..(1): TH 5' end is labeled with fluorescein.
nttttcgctgtctcgct

SEQ ID NO: 235 - DNA, 13 bp, Artificial Sequence
  Synthetic
acgagcgtctttg

SEQ ID NO: 236 - DNA, 36 bp, Artificial Sequence
  Synthetic
cacgaattcggggatgctgcccctctttgagcccaa

SEQ ID NO: 237 - DNA, 34 bp, Artificial Sequence
  Synthetic
gtgagatctatcactccttggcggagagccagtc

SEQ ID NO: 238 - DNA, 2502 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccagggggggccgggtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttccaacaccacccccgagggggtggcccggcgctacggcggggagtggacggaggaggcgggggagcgggccgccctttccgagaggctcttcgccaacctgtgggggaggcttgagggggaggagaggctcctttggctttaccgggaggtggagaggcccctttccgctgtcctggcccacatggaggccacgggggtgcgcctggacgtggcctatctcagggccttgtccctggaggtggccggggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccggggcaccgccgccgacctcatgaagctggctatggtgaagctcttccccaggctggaggaaatgggggccaggatgctccttcaggtccacgacgagctggtcctcgaggccccaaaagagagggcggaggccgtggcccggctggccaaggaggtcatggagggggtgtatcccctggccgtgcccctggaggtggaggtggggataggggaggactggctctccgccaaggagtga

SEQ ID NO: 239 - protein, 833 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAGEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVRGTAADLMKLAMVKLFPRLEEMGARMLLQVHDELVLEAPKERAEAVARLAKEVMEGVYPLAVPLEVEVGIGEDWLSAKE

SEQ ID NO: 240 - DNA, 28 bp, Artificial Sequence
  Synthetic
cacgaattccgaggcgatgcttccgctc

SEQ ID NO: 241 - DNA, 30 bp, Artificial Sequence
  Synthetic
tcgacgtcgactaacccttggcggaaagcc

SEQ ID NO: 242 - DNA, 23 bp, Artificial Sequence
  Synthetic
gcatcgcctcggaattcatggtc

SEQ ID NO: 243 - protein, 836 aa, Thermus thermophilus
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRDGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVHDELLLEAPQARAEEVAALAKEAMEKAYPLAVPLEVEVGMGEDWLSAKG

SEQ ID NO: 244 - DNA, 2511 bp, Thermus thermophilus
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcagggacggccgggtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccctccaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccacatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtccacgacgagctcctcctggaggccccccaagcgcgggccgaggaggtggcggctttggccaaggaggccatggagaaggcctatcccctcgccgtgcccctggaggtggaggtggggatgggggaggactggctttccgccaagggttag

SEQ ID NO: 245 - DNA, 30 bp, Artificial Sequence
  Synthetic
atagccatggtggagcggccgctctcccgg

SEQ ID NO: 246 - DNA, 33 bp, Artificial Sequence
  Synthetic
aagcgtcgactcaatcctgcttcgcctccagcc

SEQ ID NO: 247 - DNA, 32 bp, Artificial Sequence
  Synthetic
aatcgaattcaccccactttttgacctggagg

SEQ ID NO: 248 - DNA, 21 bp, Artificial Sequence
  Synthetic
ccgggagagcggccgctccac

SEQ ID NO: 249 - DNA, 2508 bp, Artificial Sequence
  Synthetic
atggaattcaccccactttttgacctggaggaaccccccaagcgggtgcttctggtggacggccaccacctggcctaccgcaccttctatgccctgagcctcaccacctcccggggggagccggtgcagatggtctacggcttcgcccggagcctcctcaaggccttgaaggaggacggacaggcggtggtcgtggtctttgacgccaaggccccctccttccgccacgaggcctacgaggcctacaaggcgggccgggcccccaccccggaggacttcccccgccagctcgccttggtcaagcggctggtggaccttctgggcctggtccgcctcgaggccccggggtacgaggcggacgacgtcctgggcaccctggccaagaaggccgaaagggaggggatggaggtgcgcatcctcacgggagaccgggacttcttccagctcctctccgagaaggtctcggtcctcctgccggacgggaccctggtcaccccaaaggacgtccaggagaagtacggggtgcccccggagcgctgggtggacttccgcgccctcacgggggaccgctcggacaacatccccggggtggcggggataggggagaagaccgcccttcgactcctcgcagagtgggggagcgtggaaaacctcctgaagaacctggaccgggtaaagccggactcgctccggcgcaagatagaggcgcacctcgaggacctccacctctccttagacctggcccgcatccgcaccgacctccccctggaggtggactttaaggccctgcgccgcaggacccccgacctggagggcctgagggcctttttggaggagctggagttcggaagcctcctccacgagttcggcctcctgggaggggagaagccccgggaggaggccccctggcccccgcccgaaggggccttcgtgggcttcctcctttcccgcaaggagcccatgtgggcggagcttctggccctggcggcggcctcggagggccgggtccaccgggcaacaagcccggttgaggccctggccgacctcaaggaggcccgggggttcctggccaaggacctggccgttttggccctgcgggagggggtggccctggaccccacggacgaccccctcctggtggcctacctcctggacccggccaacacccaccccgagggggtggcccggcgctacgggggcgagttcacggaggacgcagcggagagggccctcctctccgagaggctcttccagaacctctttccccggctttccgagaagctcctctggctctaccaggaggtggagcggcccctctcccgggtcttggcccacatggaggcccggggggtgaggctggacgtcccccttctggaggccctctcctttgagctggagaaggagatggagcgcctggagggggaggtcttccgtttggccggccaccccttcaacctcaactcccgcgaccagctggaaagggtcctctttgacgagctgggcctcaccccggtgggccggacggagaagacgggcaagcgctccaccgcccagggggccctggaggccctccggggggcccaccccatcgtggagctcatcctccagtaccgggagctttccaagctcaaaagcacctacctggaccccctgccccggctcgtccacccgcggacgggccggctccacacccgcttcaaccagacggccacggccacgggaaggctttccagctccgaccccaacctgcagaacatccccgtgcgcacccccttggggcagcgcatccgcaaggccttcgtggccgaggaggggtggctccttttggcggcggactactcccagattgagctccgggtcctggcccacctctcgggggacgagaacctgaagcgggtcttccgggaggggaaggacatccataccgagaccgccgcctggatgttcggcttagaccccgctctggtggatccaaagatgcgccgggcggccaagacggtcaacttcggcgtcctctacgggatgtccgcccacaggctctcccaggagctcggcatagactacaaggaggcggaggcctttattgagcgctacttccagagcttccccaaggtgcgggcctggatagaaaggaccctggaggagggccggacgcggggctacgtggagaccctgttcggcaggaggcgctatgtgcccgacctggcctcccgggtccgctcggtgcgggaggcggcggagcggatggccttcaacatgcccgtgcagggcaccgccgccgacctgatgaagatcgccatggtcaagctcttccccaggctaaagcccctgggggcccacctcctcctccaagtgcacgacgagctggtcctggaggtgcccgaggaccgggccgaggaggccaaggccctggtcaaggaggtcatggagaacgcctaccccctggacgtgcccctcgaggtggaggtgggcgtgggtcgggactggctggaggcgaagcaggattga

SEQ ID NO: 250 - protein, 835 aa, Artificial Sequence
  Synthetic
MEFTPLFDLEEPPKRVLLVDGHHLAYRTFYALSLTTSRGEPVQMVYGFARSLLKALKEDGQAVVVVFDAKAPSFRHEAYEAYKAGRAPTPEDFPRQLALVKRLVDLLGLVRLEAPGYEADDVLGTLAKKAEREGMEVRILTGDRDFFQLLSEKVSVLLPDGTLVTPKDVQEKYGVPPERWVDFRALTGDRSDNIPGVAGIGEKTALRLLAEWGSVENLLKNLDRVKPDSLRRKIEAHLEDLHLSLDLARIRTDLPLEVDFKALRRRTPDLEGLRAFLEELEFGSLLHEFGLLGGEKPREEAPWPPPEGAFVGFLLSRKEPMWAELLALAAASEGRVHRATSPVEALADLKEARGFLAKDLAVLALREGVALDPTDDPLLVAYLLDPANTHPEGVARRYGGEFTEDAAERALLSERLFQNLFPRLSEKLLWLYQEVERPLSRVLAHMEARGVRLDVPLLEALSFELEKEMERLEGEVFRLAGHPFNLNSRDQLERVLFDELGLTPVGRTEKTGKRSTAQGALEALRGAHPIVELILQYRELSKLKSTYLDPLPRLVHPRTGRLHTRFNQTATATGRLSSSDPNLQNIPVRTPLGQRIRKAFVAEEGWLLLAADYSQIELRVLAHLSGDENLKRVFREGKDIHTETAAWMFGLDPALVDPKMRRAAKTVNFGVLYGMSAHRLSQELGIDYKEAEAFIERYFQSFPKVRAWIERTLEEGRTRGYVETLFGRRRYVPDLASRVRSVREAAERMAFNMPVQGTAADLMKIAMVKLFPRLKPLGAHLLLQVHDELVLEVPEDRAEEAKALVKEVMENAYPLDVPLEVEVGVGRDWLEAKQD

SEQ ID NO: 251 - DNA, 31 bp, Artificial Sequence
  Synthetic
actggaattcctgcccctctttgagcccaag

SEQ ID NO: 252 - DNA, 30 bp, Artificial Sequence
  Synthetic
aacagtcgacctaggccttggcggaaagcc

SEQ ID NO: 253 - DNA, 2499 bp, Artificial Sequence
  Synthetic
atggaattcctgcccctctttgagcccaagggccgggtgcttctggtggacggccaccacctggcctaccgtaccttttttgccctgaagggcctcaccaccagccgcggggagccggtccaggcggtgtacgggtttgccaagagccttttgaaggcgctaagggaagacggggatgtggtgatcgtggtgtttgacgccaaggccccctccttccgccaccagacctacgaggcctacaaggcggggcgggctcccacccccgaggactttccccggcagcttgcccttatcaaggagatggtggaccttttgggcctggagcgcctcgaggtgccgggctttgaagcggatgacgtcctggctaccctggccaagaaggcggaaaaggaaggctacgaagtgcgcatcctcaccgcggaccgggacctttaccagcttctttcggagcgaatctccatccttcacccggagggttacctgatcaccccggagtggctttgggagaagtatgggcttaagccttcccagtgggtggactaccgggccttggccggggacccttccgacaacatccccggcgtgaagggcatcggggagaagacggcggccaagctgatccgggagtggggaagcctggaaaaccttcttaagcacctggaacaggtgaaacctgcctccgtgcgggagaagatccttagccacatggaggacctcaagctatccctggagctatcccgggtgcacacggacttgctccttcaggtggacttcgcccggcgccgggagccggaccgggaggggcttaaggcctttttggagaggctggagttcggaagcctcctccacgagttcggcctgttggaaagcccggtggcggcggaggaagctccctggccgccccccgagggagccttcgtggggtacgttctttcccgccccgagcccatgtgggcggagcttaacgccttggccgccgcctgggagggaagggtttaccgggcggaggatcccttggaggccttgcgggggcttggggaggtgagggggcttttggccaaggacctggcggtgctggccctgagggaagggattgccctggcaccgggcgacgaccccatgctcctcgcctacctcctggatccttccaacaccgcccccgaaggggtagcccggcgctacgggggggagtggaccgaggaggcgggggaaagggcgctgctttccgaaaggctttacgccgccctcctggagcggcttaagggggaggagaggcttctttggctttacgaggaggtggaaaagcccctttcgcgggtcctggcccacatggaggccacgggggtacggttggatgtggcctacttaaaggccctttccctggaggtggaggcggagataaggcgcttcgaggaggaggtccaccgcctggccgggcatcctttcaacctgaactcccgggaccagctggaaagggtcatctttgacgagcttgggcttcccgccatcggcaagacggagaagacgggcaagcgctccaccagcgccgccgttttggaggccttgcgggaggctcatcccatcgtggaccgcatccttcagtaccgggagctttccaagctcaagggaacctacatcgatcccttgcctgccctggtccaccccaagacgaaccgcctccacacccgtttcaaccagacggccaccgccacggggaggcttagcagctcggatcctaatctgcaaaatatccccgtgcgcacccctttgggccagcggatccgccgggccttcgtggccgaggaggggtggaggctggtggttttggactacagccagattgagctcagggtcctggcgcacctttccggggacgagaacctaatccgggtcttccaggagggccaggacatccacacccagacggccagctggatgttcggcgtgcccccagaggccgtggattccctgatgcgccgggcggccaagaccatcaacttcggcgtcctctacggcatgtccgcccaccggctttcgggagagctggccatcccctacgaggaggcggtggccttcatcgagcggtatttccagagctaccccaaggtgcgggcctggattgagaaaaccctggcggaaggacgggaacggggctatgtggaaaccctctttggccgccggcgctacgtgcccgacttggcttcccgggtgaagagcatccgggaggcagcggagcgcatggccttcaacatgccggtccaggggaccgccgcggatttgatgaaactggccatggtgaagctctttcccaggcttcaggagctgggggccaggatgcttttgcaggtgcacgacgaactggtcctcgaggctcccaaggagcaagcggaggaagtcgcccaggaggccaagcggaccatggaggaggtgtggcccctgaaggtgcccttggaggtggaagtgggcatcggggaggactggctttccgccaaggcctag

SEQ ID NO: 254 - protein, 832 aa, Artificial Sequence
  Synthetic
MEFLPLFEPKGRVLLVDGHHLAYRTFFALKGLTTSRGEPVQAVYGFAKSLLKALREDGDVVIVVFDAKAPSFRHQTYEAYKAGRAPTPEDFPRQLALIKEMVDLLGLERLEVPGFEADDVLATLAKKAEKEGYEVRILTADRDLYQLLSERISILHPEGYLITPEWLWEKYGLKPSQWVDYRALAGDPSDNIPGVKGIGEKTAAKLIREWGSLENLLKHLEQVKPASVREKILSHMEDLKLSLELSRVHTDLLLQVDFARRREPDREGLKAFLERLEFGSLLHEFGLLESPVAAEEAPWPPPEGAFVGYVLSRPEPMWAELNALAAAWEGRVYRAEDPLEALRGLGEVRGLLAKDLAVLALREGIALAPGDDPMLLAYLLDPSNTAPEGVARRYGGEWTEEAGERALLSERLYAALLERLKGEERLLWLYEEVEKPLSRVLAHMEATGVRLDVAYLKALSLEVEAEIRRFEEEVHRLAGHPFNLNSRDQLERVIFDELGLPAIGKTEKTGKRSTSAAVLEALREAHPIVDRILQYRELSKLKGTYIDPLPALVHPKTNRLHTRFNQTATATGRLSSSDPNLQNIPVRTPLGQRIRRAFVAEEGWRLVVLDYSQIELRVLAHLSGDENLIRVFQEGQDIHTQTASWMFGVPPEAVDSLMRRAAKTINFGVLYGMSAHRLSGELAIPYEEAVAFIERYFQSYPKVRAWIEKTLAEGRERGYVETLFGRRRYVPDLASRVKSIREAAERMAFNMPVQGTAADLMKLAMVKLFPRLQELGARMLLQVHDELVLEAPKEQAEEVAQEAKRTMEEVWPLKVPLEVEVGIGEDWLSAKA

SEQ ID NO: 255 - DNA, 20 bp, Artificial Sequence
  Synthetic
cgatctcctcggccacctcc

SEQ ID NO: 256 - DNA, 20 bp, Artificial Sequence
  Synthetic
ggcggtgccctggacgggca

SEQ ID NO: 257 - DNA, 20 bp, Artificial Sequence
  Synthetic
ccagctcgttgtggacctga

SEQ ID NO: 258 - DNA, 2505 bp, Thermus aquaticus
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccagggggggccgggtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttccaacaccacccccgagggggtggcccggcgctacggcggggagtggacggaggaggcgggggagcgggccgccctttccgagaggctcttcgccaacctgtgggggaggcttgagggggaggagaggctcctttggctttaccgggaggtggagaggcccctttccgctgtcctggcccacatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagtgatag

SEQ ID NO: 259 - protein, 833 aa, Thermus aquaticus
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKE

SEQ ID NO: 260 - DNA, 26 bp, Artificial Sequence
  Synthetic
caggaggagctcgttgtggacctgga

SEQ ID NO: 261 - protein, 836 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRDGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVHNELLLEAPQARAEEVAALAKEAMEKAYPLAVPLEVEVGMGEDWLSAKG

SEQ ID NO: 262 - DNA, 2511 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcagggacggccgggtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccctccaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccacatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtccacaacgagctcctcctggaggccccccaagcgcgggccgaggaggtggcggctttggccaaggaggccatggagaaggcctatcccctcgccgtgcccctggaggtggaggtggggatgggggaggactggctttccgccaagggttag

SEQ ID NO: 263 - DNA, 50 bp, Artificial Sequence
  Synthetic
tctagaggatctatcagtggtggtggtggtggtgctccttggcggagagc

SEQ ID NO: 264 - DNA, 58 bp, Artificial Sequence
  Synthetic
tgcctgcaggtcgacgctagctagtggtggtggtggtggtgacccttggcggaaagcc

SEQ ID NO: 265 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccagggggggccgggtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttccaacaccacccccgagggggtggcccggcgctacggcggggagtggacggaggaggcgggggagcgggccgccctttccgagaggctcttcgccaacctgtgggggaggcttgagggggaggagaggctcctttggctttaccgggaggtggagaggcccctttccgctgtcctggcccacatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 266 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 267 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcagggacggccgggtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccctccaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccacatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtccacaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 268 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRDGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVHNELLLEAPQARAEEVAALAKEAMEKAYPLAVPLEVEVGMGEDWLSAKGHHHHHH

SEQ ID NO: 269 - DNA, 30 bp, Artificial Sequence
  Synthetic
gccgccaggggcggccgcgtccaccgggcc

SEQ ID NO: 270 - DNA, 31 bp, Artificial Sequence
  Synthetic
gcctgcaggggcggccgcgtgcaccggggca

SEQ ID NO: 271 - DNA, 26 bp, Artificial Sequence
  Synthetic
ctcctggacccttcgaacaccacccc

SEQ ID NO: 272 - DNA, 23 bp, Artificial Sequence
  Synthetic
gtcctggcccatatggaggccac

SEQ ID NO: 273 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtccacaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 274 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVHNELLLEAPQARAEEVAALAKEAMEKAYPLAVPLEVEVGMGEDWLSAKGHHHHHH

SEQ ID NO: 275 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgtgggggaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 276 - protein, 839 aa, Artificial Sequence; identical to SEQ ID NO: 266
  Synthetic

SEQ ID NO: 277 - DNA, 27 bp, Artificial Sequence
  Synthetic
gaggaggcggggcaccgggccgccctt

SEQ ID NO: 278 - DNA, 36 bp, Artificial Sequence
  Synthetic
ctttccgagaggctccatcggaacctgtgggggagg

SEQ ID NO: 279 - DNA, 36 bp, Artificial Sequence
  Synthetic
ctcttcgccaacctgcttaagaggcttgagggggag

SEQ ID NO: 280 - DNA, 27 bp, Artificial Sequence
  Synthetic
aggcccctttcccgggtcctggcccat

SEQ ID NO: 281 - DNA, 27 bp, Artificial Sequence
  Synthetic
acgggggtgcgccgggacgtggcctat

SEQ ID NO: 282 - DNA, 27 bp, Artificial Sequence
  Synthetic
gtggcctatctccaggccttgtccctg

SEQ ID NO: 283 - DNA, 27 bp, Artificial Sequence
  Synthetic
ttgtccctggagcttgccgaggagatc

SEQ ID NO: 284 - DNA, 27 bp, Artificial Sequence
  Synthetic
gccgaggagatccgccgcctcgaggcc

SEQ ID NO: 285 - DNA, 27 bp, Artificial Sequence
  Synthetic
gcccgcctcgaggaggaggtcttccgc

SEQ ID NO: 286 - DNA, 27 bp, Artificial Sequence
  Synthetic
tttgacgagctaaggcttcccgccatc

SEQ ID NO: 287 - DNA, 27 bp, Artificial Sequence
  Synthetic
atcgccaagacgcaaaagaccggcaag

SEQ ID NO: 288 - DNA, 27 bp, Artificial Sequence
  Synthetic
aagatcctgcagcaccgggagctcacc

SEQ ID NO: 289 - DNA, 27 bp, Artificial Sequence
  Synthetic
accaagctgaagaacacctacattgac

SEQ ID NO: 290 - DNA, 27 bp, Artificial Sequence
  Synthetic
aagagcacctacgtggaccccttgccg

SEQ ID NO: 291 - DNA, 39 bp, Artificial Sequence
  Synthetic
attgaccccttgccgagcctcgtccaccccaggacgggc

SEQ ID NO: 292 - DNA, 33 bp, Artificial Sequence
  Synthetic
ttcgccaacctgcttgggaggcttgagggggag

SEQ ID NO: 293 - DNA, 33 bp, Artificial Sequence
  Synthetic
ctcttcgccaacctgtggaagaggcttgagggg

SEQ ID NO: 294 - DNA, 33 bp, Artificial Sequence
  Synthetic
gcttgcggtctgggtggcgatgtccttcccctc

SEQ ID NO: 295 - DNA, 33 bp, Artificial Sequence
  Synthetic
catgttgaaggccatggcctccgcggcctccct

SEQ ID NO: 296 - DNA, 30 bp, Artificial Sequence
  Synthetic
caggaggagctcgttggcgacctggaggag

SEQ ID NO: 297 - DNA, 45 bp, Artificial Sequence
  Synthetic
ggagcgcttgcctgtcttcttcgtcttcttcaaggcgggaggcct

SEQ ID NO: 298 - DNA, 33 bp, Artificial Sequence
  Synthetic
gaggaccagctcgttggcgacctgaaggagcat

SEQ ID NO: 299 - DNA, 33 bp, Artificial Sequence
  Synthetic
gaggggcgggacatcgccacggagaccgccagc

SEQ ID NO: 300 - DNA, 33 bp, Artificial Sequence
  Synthetic
cagaacatccccgtcgccaccccgcttgggcag

SEQ ID NO: 301 - DNA, 33 bp, Artificial Sequence
  Synthetic
gggcttcccgccatcaagaagacggagaagacc

SEQ ID NO: 302 - DNA, 39 bp, Artificial Sequence
  Synthetic
ctagggcttcccgccatcaagaagacgcaaaagaccggc

SEQ ID NO: 303 - DNA, 39 bp, Artificial Sequence
  Synthetic
ccggggaaagtcctcctccgtctcggcccggcccgcctt

SEQ ID NO: 304 - DNA, 36 bp, Artificial Sequence
  Synthetic
cgggacctcgaggcgcgtgaaccccaggaggtccac

SEQ ID NO: 305 - DNA, 18 bp, Artificial Sequence
  Synthetic
ctcctccacgagttcggc

SEQ ID NO: 306 - DNA, 48 bp, Artificial Sequence
  Synthetic
accggtcttcttcgtcttcttcaacttgggaagcctgagctcgtcaaa

SEQ ID NO: 307 - DNA, 33 bp, Artificial Sequence
  Synthetic
aagacgaagaagaccggtaagcgctccaccagc

SEQ ID NO: 308 - DNA, 52 bp, Artificial Sequence
  Synthetic
gtcgactctagatcagtggtggtggtggtggtgcttggccgcccggcgcatc

SEQ ID NO: 309 - DNA, 60 bp, Artificial Sequence
  Synthetic
  modified_base (19)..(42): The bases in these positions within tH primer are 9137711001254f the base shown and 3-2.744494e+304ach of the other 3 nucleotides.
ggagcgcttaccggtcttttgcgtcttcttgatcttgggaagccttagctcgtcaaagag

SEQ ID NO: 310 - DNA, 18 bp, Artificial Sequence
  Synthetic
ctcctccacgagttcggc

SEQ ID NO: 311 - DNA, 60 bp, Artificial Sequence
  Synthetic
  modified_base (19)..(42): The bases at these positions within tH primer are 9137711001254f the base shown and 3-2.744494e+304ach of the other 3 nucleotides.
caaaagaccggtaagcgctccaccagcgccgccgtcctggaggccctccgcgaggcccac

SEQ ID NO: 312 - DNA, 52 bp, Artificial Sequence; identical to SEQ ID NO: 308
  Synthetic

SEQ ID NO: 313 - DNA, 21 bp, Artificial Sequence
  Synthetic
gtcggaggggtcccccacgag

SEQ ID NO: 314 - DNA, 17 bp, Artificial Sequence
  Synthetic
tgtggaattgtgagcgg

SEQ ID NO: 315 - DNA, 75 bp, Artificial Sequence
  Synthetic
  modified_base (28)..(59): The bases in these positions within tH primer are 9137711001254f the base shown and 3-2.744494e+304ach of the other 3 nucleotides.
ctcgtgggggacccctccgacaacctccccggggtcaagggcatcggggagaagaccgccctcaagcttctcaag

SEQ ID NO: 316 - DNA, 23 bp, Artificial Sequence
  Synthetic
gtggcctccatatgggccaggac

SEQ ID NO: 317 - DNA, 36 bp, Artificial Sequence; identical to SEQ ID NO: 304
  Synthetic

SEQ ID NO: 318 - DNA, 39 bp, Artificial Sequence; identical to SEQ ID NO: 303
  Synthetic

SEQ ID NO: 319 - DNA, 24 bp, Artificial Sequence
  Synthetic
gtcggactcgtcaccggtcagggc

SEQ ID NO: 320 - DNA, 75 bp, Artificial Sequence
  Synthetic
  modified_base (28)..(60): The bases in these positions within tH primer are 9137711001254f the base shown and 3-2.744494e+304ach of the other 3 nucleotides.
ctgaccggtgacgagtccgacaaccttcccggggtcaagggcatcggggagaggacggcgaggaagcttctggag

SEQ ID NO: 321 - DNA, 33 bp, Artificial Sequence
  Synthetic
tagctcctgggagagggcgtgggccgacatgcc

SEQ ID NO: 322 - DNA, 34 bp, Artificial Sequence
  Synthetic
cttccagaacctctttaaacggctttccgagaag

SEQ ID NO: 323 - DNA, 34 bp, Artificial Sequence
  Synthetic
cttctcggaaagccgtttaaagaggttctggaag

SEQ ID NO: 324 - DNA, 31 bp, Artificial Sequence
  Synthetic
ccggtgggccggacgcagaagacgggcaagc

SEQ ID NO: 325 - DNA, 31 bp, Artificial Sequence
  Synthetic
gcttgcccgtcttctgcgtccggcccaccgg

SEQ ID NO: 326 - DNA, 31 bp, Artificial Sequence
  Synthetic
ctcctccaagtgcacaacgagctggtcctgg

SEQ ID NO: 327 - DNA, 31 bp, Artificial Sequence
  Synthetic
ccaggaccagctcgttgtgcacttggaggag

SEQ ID NO: 328 - DNA, 26 bp, Artificial Sequence
  Synthetic
gccgccctcctgaagcggcttaaggg

SEQ ID NO: 329 - DNA, 26 bp, Artificial Sequence
  Synthetic
cccttaagccgcttcaggagggcggc

SEQ ID NO: 330 - DNA, 28 bp, Artificial Sequence
  Synthetic
atcggcaagacgcagaagacgggcaagc

SEQ ID NO: 331 - DNA, 28 bp, Artificial Sequence
  Synthetic
gcttgcccgtcttctgcgtcttgccgat

SEQ ID NO: 332 - DNA, 27 bp, Artificial Sequence
  Synthetic
ttgcaggtgcacaacgaactggtcctc

SEQ ID NO: 333 - DNA, 27 bp, Artificial Sequence
  Synthetic
gaggaccagttcgttgtgcacctgcaa

SEQ ID NO: 334 - DNA, 36 bp, Artificial Sequence
  Synthetic
cagaccatgaattccaccccactttttgacctggag

SEQ ID NO: 335 - DNA, 36 bp, Artificial Sequence
  Synthetic
gtggacgcggccgcccgaggccgccgccagggccag

SEQ ID NO: 336 - DNA, 36 bp, Artificial Sequence
  Synthetic
cagaccatgaattccctgcccctctttgagcccaag

SEQ ID NO: 337 - DNA, 36 bp, Artificial Sequence
  Synthetic
gtaaaccgcgccgccccaggcggcggccaaggcgtt

SEQ ID NO: 338 - DNA, 30 bp, Artificial Sequence
  Synthetic
gaggtggagcggcccctctcccgggtcttg

SEQ ID NO: 339 - DNA, 30 bp, Artificial Sequence
  Synthetic
caagacccgggagaggggccgctccacctc

SEQ ID NO: 340 - DNA, 2505 bp, Artificial Sequence
  Synthetic
atggaattcaccccactttttgacctggaggaaccccccaagcgggtgcttctggtggacggccaccacctggcctaccgcaccttctatgccctgagcctcaccacctcccggggggagccggtgcagatggtctacggcttcgcccggagcctcctcaaggccttgaaggaggacggacaggcggtggtcgtggtctttgacgccaaggccccctccttccgccacgaggcctacgaggcctacaaggcgggccgggcccccaccccggaggacttcccccgccagctcgccttggtcaagcggctggtggaccttctgggcctggtccgcctcgaggccccggggtacgaggcggacgacgtcctgggcaccctggccaagaaggccgaaagggaggggatggaggtgcgcatcctcacgggagaccgggacttcttccagctcctctccgagaaggtctcggtcctcctgccggacgggaccctggtcaccccaaaggacgtccaggagaagtacggggtgcccccggagcgctgggtggacttccgcgccctcacgggggaccgctcggacaacatccccggggtggcggggataggggagaagaccgcccttcgactcctcgcagagtgggggagcgtggaaaacctcctgaagaacctggaccgggtaaagccggactcgctccggcgcaagatagaggcgcacctcgaggacctccacctctccttagacctggcccgcatccgcaccgacctccccctggaggtggactttaaggccctgcgccgcaggacccccgacctggagggcctgagggcctttttggaggagctggagttcggaagcctcctccacgagttcggcctcctgggaggggagaagccccgggaggaggccccctggcccccgcccgaaggggccttcgtgggcttcctcctttcccgcaaggagcccatgtgggcggagcttctggccctggcggcggcctcggagggccgggtccaccgggcaacaagcccggttgaggccctggccgacctcaaggaggcccgggggttcctggccaaggacctggccgttttggccctgcgggagggggtggccctggaccccacggacgaccccctcctggtggcctacctcctggacccggccaacacccaccccgagggggtggcccggcgctacgggggcgagttcacggaggacgcagcggagagggccctcctctccgagaggctcttccagaacctctttaaacggctttccgagaagctcctctggctctaccaggaggtggagcggcccctctcccgggtcttggcccacatggaggcccggggggtgaggctggacgtcccccttctggaggccctctcctttgagctggagaaggagatggagcgcctggagggggaggtcttccgtttggccggccaccccttcaacctcaactcccgcgaccagctggaaagggtcctctttgacgagctgggcctcaccccggtgggccggacgcagaagacgggcaagcgctccaccgcccagggggccctggaggccctccggggggcccaccccatcgtggagctcatcctccagtaccgggagctttccaagctcaaaagcacctacctggaccccctgccccggctcgtccacccgcggacgggccggctccacacccgcttcaaccagacggccacggccacgggaaggctttccagctccgaccccaacctgcagaacatccccgtgcgcacccccttggggcagcgcatccgcaaggccttcgtggccgaggaggggtggctccttttggcggcggactactcccagattgagctccgggtcctggcccacctctcgggggacgagaacctgaagcgggtcttccgggaggggaaggacatccataccgagaccgccgcctggatgttcggcttagaccccgctctggtggatccaaagatgcgccgggcggccaagacggtcaacttcggcgtcctctacgggatgtccgcccacaggctctcccaggagctcggcatagactacaaggaggcggaggcctttattgagcgctacttccagagcttccccaaggtgcgggcctggatagaaaggaccctggaggagggccggacgcggggctacgtggagaccctgttcggcaggaggcgctatgtgcccgacctggcctcccgggtccgctcggtgcgggaggcggcggagcggatggccttcaacatgcccgtgcagggcaccgccgccgacctgatgaagatcgccatggtcaagctcttccccaggctaaagcccctgggggcccacctcctcctccaagtgcacaacgagctggtcctggaggtgcccgaggaccgggccgaggaggccaaggccctggtcaaggaggtcatggagaacgcctaccccctggacgtgcccctcgaggtggaggtgggcgtgggtcgggactggctggaggcgaagcaggat

SEQ ID NO: 341 - protein, 835 aa, Artificial Sequence; identical to SEQ ID NO: 63
  Synthetic

SEQ ID NO: 342 - DNA, 38 bp, Artificial Sequence
  Synthetic
tggcggcggcctcgggcggccgcgtccaccgggcaaca

SEQ ID NO: 343 - DNA, 24 bp, Artificial Sequence
  Synthetic
cttctctcatccgccaaaacagcc

SEQ ID NO: 344 - DNA, 38 bp, Artificial Sequence
  Synthetic
tggccgccgcctggggcggccgcgtttaccgggcggag

SEQ ID NO: 345 - DNA, 2505 bp, Artificial Sequence
  Synthetic
atgaattccaccccactttttgacctggaggaaccccccaagcgggtgcttctggtggacggccaccacctggcctaccgcaccttctatgccctgagcctcaccacctcccggggggagccggtgcagatggtctacggcttcgcccggagcctcctcaaggccttgaaggaggacggacaggcggtggtcgtggtctttgacgccaaggccccctccttccgccacgaggcctacgaggcctacaaggcgggccgggcccccaccccggaggacttcccccgccagctcgccttggtcaagcggctggtggaccttctgggcctggtccgcctcgaggccccggggtacgaggcggacgacgtcctgggcaccctggccaagaaggccgaaagggaggggatggaggtgcgcatcctcacgggagaccgggacttcttccagctcctctccgagaaggtctcggtcctcctgccggacgggaccctggtcaccccaaaggacgtccaggagaagtacggggtgcccccggagcgctgggtggacttccgcgccctcacgggggaccgctcggacaacatccccggggtggcggggataggggagaagaccgcccttcgactcctcgcagagtgggggagcgtggaaaacctcctgaagaacctggaccgggtaaagccggactcgctccggcgcaagatagaggcgcacctcgaggacctccacctctccttagacctggcccgcatccgcaccgacctccccctggaggtggactttaaggccctgcgccgcaggacccccgacctggagggcctgagggcctttttggaggagctggagttcggaagcctcctccacgagttcggcctcctgggaggggagaagccccgggaggaggccccctggcccccgcccgaaggggccttcgtgggcttcctcctttcccgcaaggagcccatgtgggcggagcttctggccctggcggcggcctcgggcggccgcgtccaccgggcaacaagcccggttgaggccctggccgacctcaaggaggcccgggggttcctggccaaggacctggccgttttggccctgcgggagggggtggccctggaccccacggacgaccccctcctggtggcctacctcctggacccggccaacacccaccccgagggggtggcccggcgctacgggggcgagttcacggaggacgcagcggagagggccctcctctccgagaggctcttccagaacctctttaaacggctttccgagaagctcctctggctctaccaggaggtggagcggcccctctcccgggtcttggcccacatggaggcccggggggtgaggctggacgtcccccttctggaggccctctcctttgagctggagaaggagatggagcgcctggagggggaggtcttccgtttggccggccaccccttcaacctcaactcccgcgaccagctggaaagggtcctctttgacgagctgggcctcaccccggtgggccggacgcagaagacgggcaagcgctccaccgcccagggggccctggaggccctccggggggcccaccccatcgtggagctcatcctccagtaccgggagctttccaagctcaaaagcacctacctggaccccctgccccggctcgtccacccgcggacgggccggctccacacccgcttcaaccagacggccacggccacgggaaggctttccagctccgaccccaacctgcagaacatccccgtgcgcacccccttggggcagcgcatccgcaaggccttcgtggccgaggaggggtggctccttttggcggcggactactcccagattgagctccgggtcctggcccacctctcgggggacgagaacctgaagcgggtcttccgggaggggaaggacatccataccgagaccgccgcctggatgttcggcttagaccccgctctggtggatccaaagatgcgccgggcggccaagacggtcaacttcggcgtcctctacgggatgtccgcccacaggctctcccaggagctcggcatagactacaaggaggcggaggcctttattgagcgctacttccagagcttccccaaggtgcgggcctggatagaaaggaccctggaggagggccggacgcggggctacgtggagaccctgttcggcaggaggcgctatgtgcccgacctggcctcccgggtccgctcggtgcgggaggcggcggagcggatggccttcaacatgcccgtgcagggcaccgccgccgacctgatgaagatcgccatggtcaagctcttccccaggctaaagcccctgggggcccacctcctcctccaagtgcacaacgagctggtcctggaggtgcccgaggaccgggccgaggaggccaaggccctggtcaaggaggtcatggagaacgcctaccccctggacgtgcccctcgaggtggaggtgggcgtgggtcgggactggctggaggcgaagcaggat

SEQ ID NO: 346 - protein, 835 aa, Artificial Sequence
  Synthetic
MNSTPLFDLEEPPKRVLLVDGHHLAYRTFYALSLTTSRGEPVQMVYGFARSLLKALKEDGQAVVVVFDAKAPSFRHEAYEAYKAGRAPTPEDFPRQLALVKRLVDLLGLVRLEAPGYEADDVLGTLAKKAEREGMEVRILTGDRDFFQLLSEKVSVLLPDGTLVTPKDVQEKYGVPPERWVDFRALTGDRSDNIPGVAGIGEKTALRLLAEWGSVENLLKNLDRVKPDSLRRKIEAHLEDLHLSLDLARIRTDLPLEVDFKALRRRTPDLEGLRAFLEELEFGSLLHEFGLLGGEKPREEAPWPPPEGAFVGFLLSRKEPMWAELLALAAASGGRVHRATSPVEALADLKEARGFLAKDLAVLALREGVALDPTDDPLLVAYLLDPANTHPEGVARRYGGEFTEDAAERALLSERLFQNLFKRLSEKLLWLYQEVERPLSRVLAHMEARGVRLDVPLLEALSFELEKEMERLEGEVFRLAGHPFNLNSRDQLERVLFDELGLTPVGRTQKTGKRSTAQGALEALRGAHPIVELILQYRELSKLKSTYLDPLPRLVHPRTGRLHTRFNQTATATGRLSSSDPNLQNIPVRTPLGQRIRKAFVAEEGWLLLAADYSQIELRVLAHLSGDENLKRVFREGKDIHTETAAWMFGLDPALVDPKMRRAAKTVNFGVLYGMSAHRLSQELGIDYKEAEAFIERYFQSFPKVRAWIERTLEEGRTRGYVETLFGRRRYVPDLASRVRSVREAAERMAFNMPVQGTAADLMKIAMVKLFPRLKPLGAHLLLQVHNELVLEVPEDRAEEAKALVKEVMENAYPLDVPLEVEVGVGRDWLEAKQD

SEQ ID NO: 347 - DNA, 2496 bp, Artificial Sequence
  Synthetic
atgaattccctgcccctctttgagcccaagggccgggtgcttctggtggacggccaccacctggcctaccgtaccttttttgccctgaagggcctcaccaccagccgcggggagccggtccaggcggtgtacgggtttgccaagagccttttgaaggcgctaagggaagacggggatgtggtgatcgtggtgtttgacgccaaggccccctccttccgccaccagacctacgaggcctacaaggcggggcgggctcccacccccgaggactttccccggcagcttgcccttatcaaggagatggtggaccttttgggcctggagcgcctcgaggtgccgggctttgaagcggatgacgtcctggctaccctggccaagaaggcggaaaaggaaggctacgaagtgcgcatcctcaccgcggaccgggacctttaccagcttctttcggagcgaatctccatccttcacccggagggttacctgatcaccccggagtggctttgggagaagtatgggcttaagccttcccagtgggtggactaccgggccttggccggggacccttccgacaacatccccggcgtgaagggcatcggggagaagacggcggccaagctgatccgggagtggggaagcctggaaaaccttcttaagcacctggaacaggtgaaacctgcctccgtgcgggagaagatccttagccacatggaggacctcaagctatccctggagctatcccgggtgcacacggacttgctccttcaggtggacttcgcccggcgccgggagccggaccgggaggggcttaaggcctttttggagaggctggagttcggaagcctcctccacgagttcggcctgttggaaagcccggtggcggcggaggaagctccctggccgccccccgagggagccttcgtggggtacgttctttcccgccccgagcccatgtgggcggagcttaacgccttggccgccgcctggggcggccgcgtttaccgggcggaggatcccttggaggccttgcgggggcttggggaggtgagggggcttttggccaaggacctggcggtgctggccctgagggaagggattgccctggcaccgggcgacgaccccatgctcctcgcctacctcctggatccttccaacaccgcccccgaaggggtagcccggcgctacgggggggagtggaccgaggaggcgggggaaagggcgctgctttccgaaaggctttacgccgccctcctgaagcggcttaagggggaggagaggcttctttggctttacgaggaggtggaaaagcccctttcgcgggtcctggcccacatggaggccacgggggtacggttggatgtggcctacttaaaggccctttccctggaggtggaggcggagataaggcgcttcgaggaggaggtccaccgcctggccgggcatcctttcaacctgaactcccgggaccagctggaaagggtcatctttgacgagcttgggcttcccgccatcggcaagacgcagaagacgggcaagcgctccaccagcgccgccgttttggaggccttgcgggaggctcatcccatcgtggaccgcatccttcagtaccgggagctttccaagctcaagggaacctacatcgatcccttgcctgccctggtccaccccaagacgaaccgcctccacacccgtttcaaccagacggccaccgccacggggaggcttagcagctcggatcctaatctgcaaaatatccccgtgcgcacccctttgggccagcggatccgccgggccttcgtggccgaggaggggtggaggctggtggttttggactacagccagattgagctcagggtcctggcgcacctttccggggacgagaacctaatccgggtcttccaggagggccaggacatccacacccagacggccagctggatgttcggcgtgcccccagaggccgtggattccctgatgcgccgggcggccaagaccatcaacttcggcgtcctctacggcatgtccgcccaccggctttcgggagagctggccatcccctacgaggaggcggtggccttcatcgagcggtatttccagagctaccccaaggtgcgggcctggattgagaaaaccctggcggaaggacgggaacggggctatgtggaaaccctctttggccgccggcgctacgtgcccgacttggcttcccgggtgaagagcatccgggaggcagcggagcgcatggccttcaacatgccggtccaggggaccgccgcggatttgatgaaactggccatggtgaagctctttcccaggcttcaggagctgggggccaggatgcttttgcaggtgcacaacgaactggtcctcgaggctcccaaggagcaagcggaggaagtcgcccaggaggccaagcggaccatggaggaggtgtggcccctgaaggtgcccttggaggtggaagtgggcatcggggaggactggctttccgccaaggcc

SEQ ID NO: 348 - protein, 832 aa, Artificial Sequence
  Synthetic
MNSLPLFEPKGRVLLVDGHHLAYRTFFALKGLTTSRGEPVQAVYGFAKSLLKALREDGDVVIVVFDAKAPSFRHQTYEAYKAGRAPTPEDFPRQLALIKEMVDLLGLERLEVPGFEADDVLATLAKKAEKEGYEVRILTADRDLYQLLSERISILHPEGYLITPEWLWEKYGLKPSQWVDYRALAGDPSDNIPGVKGIGEKTAAKLIREWGSLENLLKHLEQVKPASVREKILSHMEDLKLSLELSRVHTDLLLQVDFARRREPDREGLKAFLERLEFGSLLHEFGLLESPVAAEEAPWPPPEGAFVGYVLSRPEPMWAELNALAAAWGGRVYRAEDPLEALRGLGEVRGLLAKDLAVLALREGIALAPGDDPMLLAYLLDPSNTAPEGVARRYGGEWTEEAGERALLSERLYAALLKRLKGEERLLWLYEEVEKPLSRVLAHMEATGVRLDVAYLKALSLEVEAEIRRFEEEVHRLAGHPFNLNSRDQLERVIFDELGLPAIGKTQKTGKRSTSAAVLEALREAHPIVDRILQYRELSKLKGTYIDPLPALVHPKTNRLHTRFNQTATATGRLSSSDPNLQNIPVRTPLGQRIRRAFVAEEGWRLVVLDYSQIELRVLAHLSGDENLIRVFQEGQDIHTQTASWMFGVPPEAVDSLMRRAAKTINFGVLYGMSAHRLSGELAIPYEEAVAFIERYFQSYPKVRAWIEKTLAEGRERGYVETLFGRRRYVPDLASRVKSIREAAERMAFNMPVQGTAADLMKLAMVKLFPRLQELGARMLLQVHNELVLEAPKEQAEEVAQEAKRTMEEVWPLKVPLEVEVGIGEDWLSAKA

SEQ ID NO: 349 - DNA, 2526 bp, Artificial Sequence
  Synthetic
atgaattccaccccactttttgacctggaggaaccccccaagcgggtgcttctggtggacggccaccacctggcctaccgcaccttctatgccctgagcctcaccacctcccggggggagccggtgcagatggtctacggcttcgcccggagcctcctcaaggccttgaaggaggacggacaggcggtggtcgtggtctttgacgccaaggccccctccttccgccacgaggcctacgaggcctacaaggcgggccgggcccccaccccggaggacttcccccgccagctcgccttggtcaagcggctggtggaccttctgggctttacccgcctcgaggccccggggtacgaggcggacgacgtcctgggcaccctggccaagaaggccgaaagggaggggatggaggtgcgcatcctcacgggagaccgggacttcttccagctcctctccgagaaggtctcggtcctcctgccggacgggaccctggtcaccccaaaggacgtccaggagaagtacggggtgcccccggagcgctgggtggacttccgcgccctcacgggggaccgctcggacaacatccccggggtggcggggataggggagaagaccgcccttcgactcctcgcagagtgggggagcgtggaaaacctcctgaagaacctggaccgggtaaagccggactcgctccggcgcaagatagaggcgcacctcgaggacctccacctctccttagacctggcccgcatccgcaccgacctccccctggaggtggactttaaggccctgcgccgcaggacccccgacctggagggcctgagggcctttttggaggagctggagttcggaagcctcctccacgagttcggcctcctgggaggggagaagccccgggaggaggccccctggcccccgcccgaaggggccttcgtgggcttcctcctttcccgcaaggagcccatgtgggcggagcttctggccctggcggcggcctcgggcggccgcgtccaccgggcaacaagcccggttgaggccctggcggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 350 - DNA, 2505 bp, Artificial Sequence
  Synthetic
atgaattccaccccactttttgacctggaggaaccccccaagcgggtgcttctggtggacggccaccacctggcctaccgcaccttctatgccctgagcctcaccacctcccggggggagccggtgcagatggtctacggcttcgcccggagcctcctcaaggccttgaaggaggacggacaggcggtggtcgtggtctttgacgccaaggccccctccttccgccacgaggcctacgaggcctacaaggcgggccgggcccccaccccggaggacttcccccgccagctcgccttggtcaagcggctggtggaccttctgggctttacccgcctcgaggccccggggtacgaggcggacgacgtcctgggcaccctggccaagaaggccgaaagggaggggatggaggtgcgcatcctcacgggagaccgggacttcttccagctcctctccgagaaggtctcggtcctcctgccggacgggaccctggtcaccccaaaggacgtccaggagaagtacggggtgcccccggagcgctgggtggacttccgcgccctcacgggggaccgctcggacaacatccccggggtggcggggataggggagaagaccgcccttcgactcctcgcagagtgggggagcgtggaaaacctcctgaagaacctggaccgggtaaagccggactcgctccggcgcaagatagaggcgcacctcgaggacctccacctctccttagacctggcccgcatccgcaccgacctccccctggaggtggactttaaggccctgcgccgcaggacccccgacctggagggcctgagggcctttttggaggagctggagttcggaagcctcctccacgagttcggcctcctgggaggggagaagccccgggaggaggccccctggcccccgcccgaaggggccttcgtgggcttcctcctttcccgcaaggagcccatgtgggcggagcttctggccctggcggcggcctcgggcggccgcgtccaccgggcaacaagcccggttgaggccctggccgacctcaaggaggcccgggggttcctggccaaggacctggccgttttggccctgcgggagggggtggccctggaccccacggacgaccccctcctggtggcctacctcctggacccggccaacacccaccccgagggggtggcccggcgctacgggggcgagttcacggaggacgcagcggagagggccctcctctccgagaggctcttccagaacctctttaaacggctttccgagaagctcctctggctctaccaggaggtggagcggcccctctcccgggtcttggcccacatggaggcccggggggtgaggctggacgtcccccttctggaggccctctcctttgagctggagaaggagatggagcgcctggagggggaggtcttccgtttggccggccaccccttcaacctcaactcccgcgaccagctggaaagggtcctctttgacgagctgggcctcaccccggtgggccggacgcagaagacgggcaagcgctccaccgcccagggggccctggaggccctccggggggcccaccccatcgtggagctcatcctccagtaccgggagctttccaagctcaaaagcacctacctggaccccctgccccggctcgtccacccgcggacgggccggctccacacccgcttcaaccagacggccacggccacgggaaggctttccagctccgaccccaacctgcagaacatccccgtgcgcacccccttggggcagcgcatccgcaaggccttcgtggccgaggaggggtggctccttttggcggcggactactcccagattgagctccgggtcctggcccacctctcgggggacgagaacctgaagcgggtcttccgggaggggaaggacatccataccgagaccgccgcctggatgttcggcttagaccccgctctggtggatccaaagatgcgccgggcggccaagacggtcaacttcggcgtcctctacgggatgtccgcccacaggctctcccaggagctcggcatagactacaaggaggcggaggcctttattgagcgctacttccagagcttccccaaggtgcgggcctggatagaaaggaccctggaggagggccggacgcggggctacgtggagaccctgttcggcaggaggcgctatgtgcccgacctggcctcccgggtccgctcggtgcgggaggcggcggagcggatggccttcaacatgcccgtgcagggcaccgccgccgacctgatgaagatcgccatggtcaagctcttccccaggctaaagcccctgggggcccacctcctcctccaagtgcacaacgagctggtcctggaggtgcccgaggaccgggccgaggaggccaaggccctggtcaaggaggtcatggagaacgcctaccccctggacgtgcccctcgaggtggaggtgggcgtgggtcgggactggctggaggcgaagcaggat

SEQ ID NO: 351 - protein, 835 aa, Artificial Sequence
  Synthetic
MNSTPLFDLEEPPKRVLLVDGHHLAYRTFYALSLTTSRGEPVQMVYGFARSLLKALKEDGQAVVVVFDAKAPSFRHEAYEAYKAGRAPTPEDFPRQLALVKRLVDLLGFTRLEAPGYEADDVLGTLAKKAEREGMEVRILTGDRDFFQLLSEKVSVLLPDGTLVTPKDVQEKYGVPPERWVDFRALTGDRSDNIPGVAGIGEKTALRLLAEWGSVENLLKNLDRVKPDSLRRKIEAHLEDLHLSLDLARIRTDLPLEVDFKALRRRTPDLEGLRAFLEELEFGSLLHEFGLLGGEKPREEAPWPPPEGAFVGFLLSRKEPMWAELLALAAASGGRVHRATSPVEALADLKEARGFLAKDLAVLALREGVALDPTDDPLLVAYLLDPANTHPEGVARRYGGEFTEDAAERALLSERLFQNLFKRLSEKLLWLYQEVERPLSRVLAHMEARGVRLDVPLLEALSFELEKEMERLEGEVFRLAGHPFNLNSRDQLERVLFDELGLTPVGRTQKTGKRSTAQGALEALRGAHPIVELILQYRELSKLKSTYLDPLPRLVHPRTGRLHTRFNQTATATGRLSSSDPNLQNIPVRTPLGQRIRKAFVAEEGWLLLAADYSQIELRVLAHLSGDENLKRVFREGKDIHTETAAWMFGLDPALVDPKMRRAAKTVNFGVLYGMSAHRLSQELGIDYKEAEAFIERYFQSFPKVRAWIERTLEEGRTRGYVETLFGRRRYVPDLASRVRSVREAAERMAFNMPVQGTAADLMKIAMVKLFPRLKPLGAHLLLQVHNELVLEVPEDRAEEAKALVKEVMENAYPLDVPLEVEVGVGRDWLEAKQD

SEQ ID NO: 352 - DNA, 2496 bp, Artificial Sequence
  Synthetic
atgaattccctgcccctctttgagcccaagggccgggtgcttctggtggacggccaccacctggcctaccgtaccttttttgccctgaagggcctcaccaccagccgcggggagccggtccaggcggtgtacgggtttgccaagagccttttgaaggcgctaagggaagacggggatgtggtgatcgtggtgtttgacgccaaggccccctccttccgccaccagacctacgaggcctacaaggcggggcgggctcccacccccgaggactttccccggcagcttgcccttatcaaggagatggtggaccttttgggctttacccgcctcgaggtgccgggctttgaagcggatgacgtcctggctaccctggccaagaaggcggaaaaggaaggctacgaagtgcgcatcctcaccgcggaccgggacctttaccagcttctttcggagcgaatctccatccttcacccggagggttacctgatcaccccggagtggctttgggagaagtatgggcttaagccttcccagtgggtggactaccgggccttggccggggacccttccgacaacatccccggcgtgaagggcatcggggagaagacggcggccaagctgatccgggagtggggaagcctggaaaaccttcttaagcacctggaacaggtgaaacctgcctccgtgcgggagaagatccttagccacatggaggacctcaagctatccctggagctatcccgggtgcacacggacttgctccttcaggtggacttcgcccggcgccgggagccggaccgggaggggcttaaggcctttttggagaggctggagttcggaagcctcctccacgagttcggcctgttggaaagcccggtggcggcggaggaagctccctggccgccccccgagggagccttcgtggggtacgttctttcccgccccgagcccatgtgggcggagcttaacgccttggccgccgcctggggcggccgcgtttaccgggcggaggatcccttggaggccttgcgggggcttggggaggtgagggggcttttggccaaggacctggcggtgctggccctgagggaagggattgccctggcaccgggcgacgaccccatgctcctcgcctacctcctggatccttccaacaccgcccccgaaggggtagcccggcgctacgggggggagtggaccgaggaggcgggggaaagggcgctgctttccgaaaggctttacgccgccctcctgaagcggcttaagggggaggagaggcttctttggctttacgaggaggtggaaaagcccctttcgcgggtcctggcccacatggaggccacgggggtacggttggatgtggcctacttaaaggccctttccctggaggtggaggcggagataaggcgcttcgaggaggaggtccaccgcctggccgggcatcctttcaacctgaactcccgggaccagctggaaagggtcatctttgacgagcttgggcttcccgccatcggcaagacgcagaagacgggcaagcgctccaccagcgccgccgttttggaggccttgcgggaggctcatcccatcgtggaccgcatccttcagtaccgggagctttccaagctcaagggaacctacatcgatcccttgcctgccctggtccaccccaagacgaaccgcctccacacccgtttcaaccagacggccaccgccacggggaggcttagcagctcggatcctaatctgcaaaatatccccgtgcgcacccctttgggccagcggatccgccgggccttcgtggccgaggaggggtggaggctggtggttttggactacagccagattgagctcagggtcctggcgcacctttccggggacgagaacctaatccgggtcttccaggagggccaggacatccacacccagacggccagctggatgttcggcgtgcccccagaggccgtggattccctgatgcgccgggcggccaagaccatcaacttcggcgtcctctacggcatgtccgcccaccggctttcgggagagctggccatcccctacgaggaggcggtggccttcatcgagcggtatttccagagctaccccaaggtgcgggcctggattgagaaaaccctggcggaaggacgggaacggggctatgtggaaaccctctttggccgccggcgctacgtgcccgacttggcttcccgggtgaagagcatccgggaggcagcggagcgcatggccttcaacatgccggtccaggggaccgccgcggatttgatgaaactggccatggtgaagctctttcccaggcttcaggagctgggggccaggatgcttttgcaggtgcacaacgaactggtcctcgaggctcccaaggagcaagcggaggaagtcgcccaggaggccaagcggaccatggaggaggtgtggcccctgaaggtgcccttggaggtggaagtgggcatcggggaggactggctttccgccaaggcc

SEQ ID NO: 353 - protein, 832 aa, Artificial Sequence
  Synthetic
MNSLPLFEPKGRVLLVDGHHLAYRTFFALKGLTTSRGEPVQAVYGFAKSLLKALREDGDVVIVVFDAKAPSFRHQTYEAYKAGRAPTPEDFPRQLALIKEMVDLLGFTRLEVPGFEADDVLATLAKKAEKEGYEVRILTADRDLYQLLSERISILHPEGYLITPEWLWEKYGLKPSQWVDYRALAGDPSDNIPGVKGIGEKTAAKLIREWGSLENLLKHLEQVKPASVREKILSHMEDLKLSLELSRVHTDLLLQVDFARRREPDREGLKAFLERLEFGSLLHEFGLLESPVAAEEAPWPPPEGAFVGYVLSRPEPMWAELNALAAAWGGRVYRAEDPLEALRGLGEVRGLLAKDLAVLALREGIALAPGDDPMLLAYLLDPSNTAPEGVARRYGGEWTEEAGERALLSERLYAALLKRLKGEERLLWLYEEVEKPLSRVLAHMEATGVRLDVAYLKALSLEVEAEIRRFEEEVHRLAGHPFNLNSRDQLERVIFDELGLPAIGKTQKTGKRSTSAAVLEALREAHPIVDRILQYRELSKLKGTYIDPLPALVHPKTNRLHTRFNQTATATGRLSSSDPNLQNIPVRTPLGQRIRRAFVAEEGWRLVVLDYSQIELRVLAHLSGDENLIRVFQEGQDIHTQTASWMFGVPPEAVDSLMRRAAKTINFGVLYGMSAHRLSGELAIPYEEAVAFIERYFQSYPKVRAWIEKTLAEGRERGYVETLFGRRRYVPDLASRVKSIREAAERMAFNMPVQGTAADLMKLAMVKLFPRLQELGARMLLQVHNELVLEAPKEQAEEVAQEAKRTMEEVWPLKVPLEVEVGIGEDWLSAKA

SEQ ID NO: 354 - DNA, 42 bp, Artificial Sequence
  Synthetic
ggcctcaccccggtgaagcggacgaagaagacgggcaagcgc

SEQ ID NO: 355 - DNA, 42 bp, Artificial Sequence
  Synthetic
gcgcttgcccgtcttcttcgtccgcttcaccggggtgaggcc

SEQ ID NO: 356 - DNA, 33 bp, Artificial Sequence
  Synthetic
ctcctcctccaagtggccaacgagctggtcctg

SEQ ID NO: 357 - DNA, 33 bp, Artificial Sequence
  Synthetic
caggaccagctcgttggccacttggaggaggag

SEQ ID NO: 358 - DNA, 2505 bp, Artificial Sequence
  Synthetic
atgaattccaccccactttttgacctggaggaaccccccaagcgggtgcttctggtggacggccaccacctggcctaccgcaccttctatgccctgagcctcaccacctcccggggggagccggtgcagatggtctacggcttcgcccggagcctcctcaaggccttgaaggaggacggacaggcggtggtcgtggtctttgacgccaaggccccctccttccgccacgaggcctacgaggcctacaaggcgggccgggcccccaccccggaggacttcccccgccagctcgccttggtcaagcggctggtggaccttctgggcctggtccgcctcgaggccccggggtacgaggcggacgacgtcctgggcaccctggccaagaaggccgaaagggaggggatggaggtgcgcatcctcacgggagaccgggacttcttccagctcctctccgagaaggtctcggtcctcctgccggacgggaccctggtcaccccaaaggacgtccaggagaagtacggggtgcccccggagcgctgggtggacttccgcgccctcacgggggaccgctcggacaacatccccggggtggcggggataggggagaagaccgcccttcgactcctcgcagagtgggggagcgtggaaaacctcctgaagaacctggaccgggtaaagccggactcgctccggcgcaagatagaggcgcacctcgaggacctccacctctccttagacctggcccgcatccgcaccgacctccccctggaggtggactttaaggccctgcgccgcaggacccccgacctggagggcctgagggcctttttggaggagctggagttcggaagcctcctccacgagttcggcctcctgggaggggagaagccccgggaggaggccccctggcccccgcccgaaggggccttcgtgggcttcctcctttcccgcaaggagcccatgtgggcggagcttctggccctggcggcggcctcgggcggccgcgtccaccgggcaacaagcccggttgaggccctggccgacctcaaggaggcccgggggttcctggccaaggacctggccgttttggccctgcgggagggggtggccctggaccccacggacgaccccctcctggtggcctacctcctggacccggccaacacccaccccgagggggtggcccggcgctacgggggcgagttcacggaggacgcagcggagagggccctcctctccgagaggctcttccagaacctctttaaacggctttccgagaagctcctctggctctaccaggaggtggagcggcccctctcccgggtcttggcccacatggaggcccggggggtgaggctggacgtcccccttctggaggccctctcctttgagctggagaaggagatggagcgcctggagggggaggtcttccgtttggccggccaccccttcaacctcaactcccgcgaccagctggaaagggtcctctttgacgagctgggcctcaccccggtgaagcggacgaagaagacgggcaagcgctccaccgcccagggggccctggaggccctccggggggcccaccccatcgtggagctcatcctccagtaccgggagctttccaagctcaaaagcacctacctggaccccctgccccggctcgtccacccgcggacgggccggctccacacccgcttcaaccagacggccacggccacgggaaggctttccagctccgaccccaacctgcagaacatccccgtgcgcacccccttggggcagcgcatccgcaaggccttcgtggccgaggaggggtggctccttttggcggcggactactcccagattgagctccgggtcctggcccacctctcgggggacgagaacctgaagcgggtcttccgggaggggaaggacatccataccgagaccgccgcctggatgttcggcttagaccccgctctggtggatccaaagatgcgccgggcggccaagacggtcaacttcggcgtcctctacgggatgtccgcccacaggctctcccaggagctcggcatagactacaaggaggcggaggcctttattgagcgctacttccagagcttccccaaggtgcgggcctggatagaaaggaccctggaggagggccggacgcggggctacgtggagaccctgttcggcaggaggcgctatgtgcccgacctggcctcccgggtccgctcggtgcgggaggcggcggagcggatggccttcaacatgcccgtgcagggcaccgccgccgacctgatgaagatcgccatggtcaagctcttccccaggctaaagcccctgggggcccacctcctcctccaagtggccaacgagctggtcctggaggtgcccgaggaccgggccgaggaggccaaggccctggtcaaggaggtcatggagaacgcctaccccctggacgtgcccctcgaggtggaggtgggcgtgggtcgggactggctggaggcgaagcaggat

SEQ ID NO: 359 - protein, 835 aa, Artificial Sequence
  Synthetic
MNSTPLFDLEEPPKRVLLVDGHHLAYRTFYALSLTTSRGEPVQMVYGFARSLLKALKEDGQAVVVVFDAKAPSFRHEAYEAYKAGRAPTPEDFPRQLALVKRLVDLLGLVRLEAPGYEADDVLGTLAKKAEREGMEVRILTGDRDFFQLLSEKVSVLLPDGTLVTPKDVQEKYGVPPERWVDFRALTGDRSDNIPGVAGIGEKTALRLLAEWGSVENLLKNLDRVKPDSLRRKIEAHLEDLHLSLDLARIRTDLPLEVDFKALRRRTPDLEGLRAFLEELEFGSLLHEFGLLGGEKPREEAPWPPPEGAFVGFLLSRKEPMWAELLALAAASGGRVHRATSPVEALADLKEARGFLAKDLAVLALREGVALDPTDDPLLVAYLLDPANTHPEGVARRYGGEFTEDAAERALLSERLFQNLFKRLSEKLLWLYQEVERPLSRVLAHMEARGVRLDVPLLEALSFELEKEMERLEGEVFRLAGHPFNLNSRDQLERVLFDELGLTPVKRTKKTGKRSTAQGALEALRGAHPIVELILQYRELSKLKSTYLDPLPRLVHPRTGRLHTRFNQTATATGRLSSSDPNLQNIPVRTPLGQRIRKAFVAEEGWLLLAADYSQIELRVLAHLSGDENLKRVFREGKDIHTETAAWMFGLDPALVDPKMRRAAKTVNFGVLYGMSAHRLSQELGIDYKEAEAFIERYFQSFPKVRAWIERTLEEGRTRGYVETLFGRRRYVPDLASRVRSVREAAERMAFNMPVQGTAADLMKIAMVKLFPRLKPLGAHLLLQVANELVLEVPEDRAEEAKALVKEVMENAYPLDVPLEVEVGVGRDWLEAKQD

SEQ ID NO: 360 - DNA, 42 bp, Artificial Sequence
  Synthetic
gggcttcccgccatcaagaagacgaagaagacgggcaagcgc

SEQ ID NO: 361 - DNA, 42 bp, Artificial Sequence
  Synthetic
gcgcttgcccgtcttcttcgtcttcttgatggcgggaagccc

SEQ ID NO: 362 - DNA, 33 bp, Artificial Sequence
  Synthetic
atgcttttgcaggtggccaacgaactggtcctc

SEQ ID NO: 363 - DNA, 33 bp, Artificial Sequence
  Synthetic
gaggaccagttcgttggccacctgcaaaagcat

SEQ ID NO: 364 - DNA, 2496 bp, Artificial Sequence
  Synthetic
atgaattccctgcccctctttgagcccaagggccgggtgcttctggtggacggccaccacctggcctaccgtaccttttttgccctgaagggcctcaccaccagccgcggggagccggtccaggcggtgtacgggtttgccaagagccttttgaaggcgctaagggaagacggggatgtggtgatcgtggtgtttgacgccaaggccccctccttccgccaccagacctacgaggcctacaaggcggggcgggctcccacccccgaggactttccccggcagcttgcccttatcaaggagatggtggaccttttgggcctggagcgcctcgaggtgccgggctttgaagcggatgacgtcctggctaccctggccaagaaggcggaaaaggaaggctacgaagtgcgcatcctcaccgcggaccgggacctttaccagcttctttcggagcgaatctccatccttcacccggagggttacctgatcaccccggagtggctttgggagaagtatgggcttaagccttcccagtgggtggactaccgggccttggccggggacccttccgacaacatccccggcgtgaagggcatcggggagaagacggcggccaagctgatccgggagtggggaagcctggaaaaccttcttaagcacctggaacaggtgaaacctgcctccgtgcgggagaagatccttagccacatggaggacctcaagctatccctggagctatcccgggtgcacacggacttgctccttcaggtggacttcgcccggcgccgggagccggaccgggaggggcttaaggcctttttggagaggctggagttcggaagcctcctccacgagttcggcctgttggaaagcccggtggcggcggaggaagctccctggccgccccccgagggagccttcgtggggtacgttctttcccgccccgagcccatgtgggcggagcttaacgccttggccgccgcctggggcggccgcgtttaccgggcggaggatcccttggaggccttgcgggggcttggggaggtgagggggcttttggccaaggacctggcggtgctggccctgagggaagggattgccctggcaccgggcgacgaccccatgctcctcgcctacctcctggatccttccaacaccgcccccgaaggggtagcccggcgctacgggggggagtggaccgaggaggcgggggaaagggcgctgctttccgaaaggctttacgccgccctcctgaagcggcttaagggggaggagaggcttctttggctttacgaggaggtggaaaagcccctttcgcgggtcctggcccacatggaggccacgggggtacggttggatgtggcctacttaaaggccctttccctggaggtggaggcggagataaggcgcttcgaggaggaggtccaccgcctggccgggcatcctttcaacctgaactcccgggaccagctggaaagggtcatctttgacgagcttgggcttcccgccatcaagaagacgaggaagacgggcaagcgctccaccagcgccgccgttttggaggccttgcgggaggctcatcccatcgtggaccgcatccttcagtaccgggagctttccaagctcaagggaacctacatcgatcccttgcctgccctggtccaccccaagacgaaccgcctccacacccgtttcaaccagacggccaccgccacggggaggcttagcagctcggatcctaatctgcaaaatatccccgtgcgcacccctttgggccagcggatccgccgggccttcgtggccgaggaggggtggaggctggtggttttggactacagccagattgagctcagggtcctggcgcacctttccggggacgagaacctaatccgggtcttccaggagggccaggacatccacacccagacggccagctggatgttcggcgtgcccccagaggccgtggattccctgatgcgccgggcggccaagaccatcaacttcggcgtcctctacggcatgtccgcccaccggctttcgggagagctggccatcccctacgaggaggcggtggccttcatcgagcggtatttccagagctaccccaaggtgcgggcctggattgagaaaaccctggcggaaggacgggaacggggctatgtggaaaccctctttggccgccggcgctacgtgcccgacttggcttcccgggtgaagagcatccgggaggcagcggagcgcatggccttcaacatgccggtccaggggaccgccgcggatttgatgaaactggccatggtgaagctctttcccaggcttcaggagctgggggccaggatgcttttgcaggtgcacaacgaactggtcctcgaggctcccaaggagcaagcggaggaagtcgcccaggaggccaagcggaccatggaggaggtgtggcccctgaaggtgcccttggaggtggaagtgggcatcggggaggactggctttccgccaaggcc

SEQ ID NO: 365 - protein, 832 aa, Artificial Sequence
  Synthetic
MNSLPLFEPKGRVLLVDGHHLAYRTFFALKGLTTSRGEPVQAVYGFAKSLLKALREDGDVVIVVFDAKAPSFRHQTYEAYKAGRAPTPEDFPRQLALIKEMVDLLGLERLEVPGFEADDVLATLAKKAEKEGYEVRILTADRDLYQLLSERISILHPEGYLITPEWLWEKYGLKPSQWVDYRALAGDPSDNIPGVKGIGEKTAAKLIREWGSLENLLKHLEQVKPASVREKILSHMEDLKLSLELSRVHTDLLLQVDFARRREPDREGLKAFLERLEFGSLLHEFGLLESPVAAEEAPWPPPEGAFVGYVLSRPEPMWAELNALAAAWGGRVYRAEDPLEALRGLGEVRGLLAKDLAVLALREGIALAPGDDPMLLAYLLDPSNTAPEGVARRYGGEWTEEAGERALLSERLYAALLKRLKGEERLLWLYEEVEKPLSRVLAHMEATGVRLDVAYLKALSLEVEAEIRRFEEEVHRLAGHPFNLNSRDQLERVIFDELGLPAIKKTRKTGKRSTSAAVLEALREAHPIVDRILQYRELSKLKGTYIDPLPALVHPKTNRLHTRFNQTATATGRLSSSDPNLQNIPVRTPLGQRIRRAFVAEEGWRLVVLDYSQIELRVLAHLSGDENLIRVFQEGQDIHTQTASWMFGVPPEAVDSLMRRAAKTINFGVLYGMSAHRLSGELAIPYEEAVAFIERYFQSYPKVRAWIEKTLAEGRERGYVETLFGRRRYVPDLASRVKSIREAAERMAFNMPVQGTAADLMKLAMVKLFPRLQELGARMLLQVHNELVLEAPKEQAEEVAQEAKRTMEEVWPLKVPLEVEVGIGEDWLSAKA

SEQ ID NO: 366 - DNA, 2505 bp, Artificial Sequence
  Synthetic
atgaattccaccccactttttgacctggaggaaccccccaagcgggtgcttctggtggacggccaccacctggcctaccgcaccttctatgccctgagcctcaccacctcccggggggagccggtgcagatggtctacggcttcgcccggagcctcctcaaggccttgaaggaggacggacaggcggtggtcgtggtctttgacgccaaggccccctccttccgccacgaggcctacgaggcctacaaggcgggccgggcccccaccccggaggacttcccccgccagctcgccttggtcaagcggctggtggaccttctgggctttacccgcctcgaggccccggggtacgaggcggacgacgtcctgggcaccctggccaagaaggccgaaagggaggggatggaggtgcgcatcctcacgggagaccgggacttcttccagctcctctccgagaaggtctcggtcctcctgccggacgggaccctggtcaccccaaaggacgtccaggagaagtacggggtgcccccggagcgctgggtggacttccgcgccctcacgggggaccgctcggacaacatccccggggtggcggggataggggagaagaccgcccttcgactcctcgcagagtgggggagcgtggaaaacctcctgaagaacctggaccgggtaaagccggactcgctccggcgcaagatagaggcgcacctcgaggacctccacctctccttagacctggcccgcatccgcaccgacctccccctggaggtggactttaaggccctgcgccgcaggacccccgacctggagggcctgagggcctttttggaggagctggagttcggaagcctcctccacgagttcggcctcctgggaggggagaagccccgggaggaggccccctggcccccgcccgaaggggccttcgtgggcttcctcctttcccgcaaggagcccatgtgggcggagcttctggccctggcggcggcctcgggcggccgcgtccaccgggcaacaagcccggttgaggccctggccgacctcaaggaggcccgggggttcctggccaaggacctggccgttttggccctgcgggagggggtggccctggaccccacggacgaccccctcctggtggcctacctcctggacccggccaacacccaccccgagggggtggcccggcgctacgggggcgagttcacggaggacgcagcggagagggccctcctctccgagaggctcttccagaacctctttaaacggctttccgagaagctcctctggctctaccaggaggtggagcggcccctctcccgggtcttggcccacatggaggcccggggggtgaggctggacgtcccccttctggaggccctctcctttgagctggagaaggagatggagcgcctggagggggaggtcttccgtttggccggccaccccttcaacctcaactcccgcgaccagctggaaagggtcctctttgacgagctgggcctcaccccggtgaagcggacgaagaagacgggcaagcgctccaccgcccagggggccctggaggccctccggggggcccaccccatcgtggagctcatcctccagtaccgggagctttccaagctcaaaagcacctacctggaccccctgccccggctcgtccacccgcggacgggccggctccacacccgcttcaaccagacggccacggccacgggaaggctttccagctccgaccccaacctgcagaacatccccgtgcgcacccccttggggcagcgcatccgcaaggccttcgtggccgaggaggggtggctccttttggcggcggactactcccagattgagctccgggtcctggcccacctctcgggggacgagaacctgaagcgggtcttccgggaggggaaggacatccataccgagaccgccgcctggatgttcggcttagaccccgctctggtggatccaaagatgcgccgggcggccaagacggtcaacttcggcgtcctctacgggatgtccgcccacaggctctcccaggagctcggcatagactacaaggaggcggaggcctttattgagcgctacttccagagcttccccaaggtgcgggcctggatagaaaggaccctggaggagggccggacgcggggctacgtggagaccctgttcggcaggaggcgctatgtgcccgacctggcctcccgggtccgctcggtgcgggaggcggcggagcggatggccttcaacatgcccgtgcagggcaccgccgccgacctgatgaagatcgccatggtcaagctcttccccaggctaaagcccctgggggcccacctcctcctccaagtggccaacgagctggtcctggaggtgcccgaggaccgggccgaggaggccaaggccctggtcaaggaggtcatggagaacgcctaccccctggacgtgcccctcgaggtggaggtgggcgtgggtcgggactggctggaggcgaagcaggat

SEQ ID NO: 367 - protein, 835 aa, Artificial Sequence
  Synthetic
MNSTPLFDLEEPPKRVLLVDGHHLAYRTFYALSLTTSRGEPVQMVYGFARSLLKALKEDGQAVVVVFDAKAPSFRHEAYEAYKAGRAPTPEDFPRQLALVKRLVDLLGFTRLEAPGYEADDVLGTLAKKAEREGMEVRILTGDRDFFQLLSEKVSVLLPDGTLVTPKDVQEKYGVPPERWVDFRALTGDRSDNIPGVAGIGEKTALRLLAEWGSVENLLKNLDRVKPDSLRRKIEAHLEDLHLSLDLARIRTDLPLEVDFKALRRRTPDLEGLRAFLEELEFGSLLHEFGLLGGEKPREEAPWPPPEGAFVGFLLSRKEPMWAELLALAAASGGRVHRATSPVEALADLKEARGFLAKDLAVLALREGVALDPTDDPLLVAYLLDPANTHPEGVARRYGGEFTEDAAERALLSERLFQNLFKRLSEKLLWLYQEVERPLSRVLAHMEARGVRLDVPLLEALSFELEKEMERLEGEVFRLAGHPFNLNSRDQLERVLFDELGLTPVKRTKKTGKRSTAQGALEALRGAHPIVELILQYRELSKLKSTYLDPLPRLVHPRTGRLHTRFNQTATATGRLSSSDPNLQNIPVRTPLGQRIRKAFVAEEGWLLLAADYSQIELRVLAHLSGDENLKRVFREGKDIHTETAAWMFGLDPALVDPKMRRAAKTVNFGVLYGMSAHRLSQELGIDYKEAEAFIERYFQSFPKVRAWIERTLEEGRTRGYVETLFGRRRYVPDLASRVRSVREAAERMAFNMPVQGTAADLMKIAMVKLFPRLKPLGAHLLLQVANELVLEVPEDRAEEAKALVKEVMENAYPLDVPLEVEVGVGRDWLEAKQD

SEQ ID NO: 368 - DNA, 2496 bp, Artificial Sequence
  Synthetic
atgaattccctgcccctctttgagcccaagggccgggtgcttctggtggacggccaccacctggcctaccgtaccttttttgccctgaagggcctcaccaccagccgcggggagccggtccaggcggtgtacgggtttgccaagagccttttgaaggcgctaagggaagacggggatgtggtgatcgtggtgtttgacgccaaggccccctccttccgccaccagacctacgaggcctacaaggcggggcgggctcccacccccgaggactttccccggcagcttgcccttatcaaggagatggtggaccttttgggctttacccgcctcgaggtgccgggctttgaagcggatgacgtcctggctaccctggccaagaaggcggaaaaggaaggctacgaagtgcgcatcctcaccgcggaccgggacctttaccagcttctttcggagcgaatctccatccttcacccggagggttacctgatcaccccggagtggctttgggagaagtatgggcttaagccttcccagtgggtggactaccgggccttggccggggacccttccgacaacatccccggcgtgaagggcatcggggagaagacggcggccaagctgatccgggagtggggaagcctggaaaaccttcttaagcacctggaacaggtgaaacctgcctccgtgcgggagaagatccttagccacatggaggacctcaagctatccctggagctatcccgggtgcacacggacttgctccttcaggtggacttcgcccggcgccgggagccggaccgggaggggcttaaggcctttttggagaggctggagttcggaagcctcctccacgagttcggcctgttggaaagcccggtggcggcggaggaagctccctggccgccccccgagggagccttcgtggggtacgttctttcccgccccgagcccatgtgggcggagcttaacgccttggccgccgcctggggcggccgcgtttaccgggcggaggatcccttggaggccttgcgggggcttggggaggtgagggggcttttggccaaggacctggcggtgctggccctgagggaagggattgccctggcaccgggcgacgaccccatgctcctcgcctacctcctggatccttccaacaccgcccccgaaggggtagcccggcgctacgggggggagtggaccgaggaggcgggggaaagggcgctgctttccgaaaggctttacgccgccctcctgaagcggcttaagggggaggagaggcttctttggctttacgaggaggtggaaaagcccctttcgcgggtcctggcccacatggaggccacgggggtacggttggatgtggcctacttaaaggccctttccctggaggtggaggcggagataaggcgcttcgaggaggaggtccaccgcctggccgggcatcctttcaacctgaactcccgggaccagctggaaagggtcatctttgacgagcttgggcttcccgccatcaagaagacgaggaagacgggcaagcgctccaccagcgccgccgttttggaggccttgcgggaggctcatcccatcgtggaccgcatccttcagtaccgggagctttccaagctcaagggaacctacatcgatcccttgcctgccctggtccaccccaagacgaaccgcctccacacccgtttcaaccagacggccaccgccacggggaggcttagcagctcggatcctaatctgcaaaatatccccgtgcgcacccctttgggccagcggatccgccgggccttcgtggccgaggaggggtggaggctggtggttttggactacagccagattgagctcagggtcctggcgcacctttccggggacgagaacctaatccgggtcttccaggagggccaggacatccacacccagacggccagctggatgttcggcgtgcccccagaggccgtggattccctgatgcgccgggcggccaagaccatcaacttcggcgtcctctacggcatgtccgcccaccggctttcgggagagctggccatcccctacgaggaggcggtggccttcatcgagcggtatttccagagctaccccaaggtgcgggcctggattgagaaaaccctggcggaaggacgggaacggggctatgtggaaaccctctttggccgccggcgctacgtgcccgacttggcttcccgggtgaagagcatccgggaggcagcggagcgcatggccttcaacatgccggtccaggggaccgccgcggatttgatgaaactggccatggtgaagctctttcccaggcttcaggagctgggggccaggatgcttttgcaggtgcacaacgaactggtcctcgaggctcccaaggagcaagcggaggaagtcgcccaggaggccaagcggaccatggaggaggtgtggcccctgaaggtgcccttggaggtggaagtgggcatcggggaggactggctttccgccaaggcc

SEQ ID NO: 369 - protein, 832 aa, Artificial Sequence
  Synthetic
MNSLPLFEPKGRVLLVDGHHLAYRTFFALKGLTTSRGEPVQAVYGFAKSLLKALREDGDVVIVVFDAKAPSFRHQTYEAYKAGRAPTPEDFPRQLALIKEMVDLLGFTRLEVPGFEADDVLATLAKKAEKEGYEVRILTADRDLYQLLSERISILHPEGYLITPEWLWEKYGLKPSQWVDYRALAGDPSDNIPGVKGIGEKTAAKLIREWGSLENLLKHLEQVKPASVREKILSHMEDLKLSLELSRVHTDLLLQVDFARRREPDREGLKAFLERLEFGSLLHEFGLLESPVAAEEAPWPPPEGAFVGYVLSRPEPMWAELNALAAAWGGRVYRAEDPLEALRGLGEVRGLLAKDLAVLALREGIALAPGDDPMLLAYLLDPSNTAPEGVARRYGGEWTEEAGERALLSERLYAALLKRLKGEERLLWLYEEVEKPLSRVLAHMEATGVRLDVAYLKALSLEVEAEIRRFEEEVHRLAGHPFNLNSRDQLERVIFDELGLPAIKKTRKTGKRSTSAAVLEALREAHPIVDRILQYRELSKLKGTYIDPLPALVHPKTNRLHTRFNQTATATGRLSSSDPNLQNIPVRTPLGQRIRRAFVAEEGWRLVVLDYSQIELRVLAHLSGDENLIRVFQEGQDIHTQTASWMFGVPPEAVDSLMRRAAKTINFGVLYGMSAHRLSGELAIPYEEAVAFIERYFQSYPKVRAWIEKTLAEGRERGYVETLFGRRRYVPDLASRVKSIREAAERMAFNMPVQGTAADLMKLAMVKLFPRLQELGARMLLQVHNELVLEAPKEQAEEVAQEAKRTMEEVWPLKVPLEVEVGIGEDWLSAKA

SEQ ID NO: 370 - DNA, 33 bp, Artificial Sequence
  Synthetic
ccctccgacaacctcgccggggtcaagggcatc

SEQ ID NO: 371 - DNA, 33 bp, Artificial Sequence
  Synthetic
ccctccgacaacctcaagggggtcaagggcatc

SEQ ID NO: 372 - DNA, 18 bp, Artificial Sequence
  Synthetic
gaggttgtcggaggggtc

SEQ ID NO: 373 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctcgccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 374 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLAGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 375 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctcaagggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 376 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLKGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 377 - DNA, 36 bp, Artificial Sequence
  Synthetic
gagaggctccatcggaagaagcttaagcgcctcgag

SEQ ID NO: 378 - DNA, 18 bp, Artificial Sequence
  Synthetic
ccgatggagcctctccga

SEQ ID NO: 379 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaagaagcttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 380 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRKKLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 381 - DNA, 33 bp, Artificial Sequence
  Synthetic
gtgcgcaccgacctcctcctggaggtggacctc

SEQ ID NO: 382 - DNA, 33 bp, Artificial Sequence
  Synthetic
gaggtccacctccaggaggaggtcggtgcgcac

SEQ ID NO: 383 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctcctcctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 384 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLLLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 385 - DNA, 33 bp, Artificial Sequence
  Synthetic
ggggccttcgtgggctacgtcctctcccgcccc

SEQ ID NO: 386 - DNA, 33 bp, Artificial Sequence
  Synthetic
ggggcgggagaggacgtagcccacgaaggcccc

SEQ ID NO: 387 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggctacgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 388 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGYVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 389 - DNA, 42 bp, Artificial Sequence
  Synthetic
gaaaacctcctcaagcacctggaccaggtaaagccagaaaac

SEQ ID NO: 390 - DNA, 42 bp, Artificial Sequence
  Synthetic
gttttctggctttacctggtccaggtgcttgaggaggttttc

SEQ ID NO: 391 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagcacctggaccaggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 392 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKHLDQVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 393 - DNA, 33 bp, Artificial Sequence
  Synthetic
gagctctcccgggtgcacaccgacctccccctg

SEQ ID NO: 394 - DNA, 33 bp, Artificial Sequence
  Synthetic
cagggggaggtcggtgtgcacccgggagagctc

SEQ ID NO: 395 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcacaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 396 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVHTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 397 - DNA, 33 bp, Artificial Sequence
  Synthetic
gagctctcccgggtgcacaccgacctcctcctg

SEQ ID NO: 398 - DNA, 33 bp, Artificial Sequence
  Synthetic
caggaggaggtcggtgtgcacccgggagagctc

SEQ ID NO: 399 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcacaccgacctcctcctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 400 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVHTDLLLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 401 - DNA, 2508 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcgtttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggt

SEQ ID NO: 402 - protein, 836 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLVWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKG

SEQ ID NO: 403 - DNA, 66 bp, Artificial Sequence
  Synthetic
  modified_base (19)..(51): The bases in these positions are a synthesis of 91base shown an d 3all other bases.
ctccatcggaacctccttaagcgcctcgagggggaggagaagctcctttggctctaccacgaggtg

SEQ ID NO: 404 - DNA, 18 bp, Artificial Sequence
  Synthesis
aaggaggttccgatggag

SEQ ID NO: 405 - DNA, 2508 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggtggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggt

SEQ ID NO: 406 - protein, 836 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGVEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKG

SEQ ID NO: 407 - DNA, 2508 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgaaacgaggggaaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggt

SEQ ID NO: 408 - protein, 836 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRNEGKEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKG

SEQ ID NO: 409 - DNA, 2508 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcttcgagggggaggagaagctcctttgcctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggt

SEQ ID NO: 410 - protein, 836 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRFEGEEKLLCLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKG

SEQ ID NO: 411 - DNA, 2508 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttccctttttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggt

SEQ ID NO: 412 - protein, 836 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPFLKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKG

SEQ ID NO: 413 - DNA, 42 bp, Artificial Sequence
  Synthetic
  misc_feature (19)..(21): n is any base a,t,c, or g.
caggagcttaggcttcccnnnttgaagaagacgaagaagaca

SEQ ID NO: 414 - DNA, 18 bp, Artificial Sequence
  Synthetic
cctaagctcgtcaaagag

SEQ ID NO: 415 - DNA, 2508 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgttttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggt

SEQ ID NO: 416 - protein, 836 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPVLKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKG

SEQ ID NO: 417 - DNA, 2508 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccagtttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggt

SEQ ID NO: 418 - protein, 836 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPSLKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKG

SEQ ID NO: 419 - DNA, 2508 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccggtgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggt

SEQ ID NO: 420 - protein, 836 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTGAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKG

SEQ ID NO: 421 - DNA, 42 bp, Artificial Sequence
  Synthetic
  misc_feature (16)..(18): n is any base a,t,c, or g.
ggcaagcgctccaccnnngccgcggtgctggaggccctacgg

SEQ ID NO: 422 - DNA, 15 bp, Artificial Sequence
  Synthetic
ggtggagcgcttgcc

SEQ ID NO: 423 - DNA, 2508 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcttagcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggt

SEQ ID NO: 424 - protein, 836 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSLAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKG

SEQ ID NO: 425 - DNA, 42 bp, Artificial Sequence
  Synthetic
  n (19)..(21): n is any base a,t,c, or g.
  misc_feature (19)..(21): n is any base a,t,c, or g.
ggcaagcgctccaccagcnnngcggtgctggaggccctacgg

SEQ ID NO: 426 - DNA, 2508 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagccgtgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggt

SEQ ID NO: 427 - protein, 836 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSRAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKG

SEQ ID NO: 428 - DNA, 2499 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgccgggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcaagaagacgcaaaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggag

SEQ ID NO: 429 - protein, 833 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRRDVAYLRALSLEVAEEIARLEAEVFRLAGHPFNLNSRDQLERVLFDELGLPAIKKTQKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKE

SEQ ID NO: 430 - DNA, 27 bp, Artificial Sequence
  Synthetic
acgggggtgcgccgggacgtggcctat

SEQ ID NO: 431 - DNA, 2508 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccaagttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggt

SEQ ID NO: 432 - protein, 836 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPKLKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKG

SEQ ID NO: 433 - DNA, 36 bp, Artificial Sequence
  Synthetic
cttaggcttcccaagttgaagaagacgaagaagaca

SEQ ID NO: 434 - DNA, 36 bp, Artificial Sequence
  Synthetic
tgtcttcttcgtcttcttcaacttgggaagcctaag

SEQ ID NO: 435 - DNA, 2508 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatcgccacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggt

SEQ ID NO: 436 - protein, 836 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIATQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKG

SEQ ID NO: 437 - DNA, 33 bp, Artificial Sequence
  Synthetic
gaggggaaggacatcgccacccagaccgcaagc

SEQ ID NO: 438 - DNA, 33 bp, Artificial Sequence; identical to SEQ ID NO: 294
  Synthetic

SEQ ID NO: 439 - DNA, 2508 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagccgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggt

SEQ ID NO: 440 - protein, 836 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKPKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKG

SEQ ID NO: 441 - DNA, 33 bp, Artificial Sequence
  Synthetic
cccgccttgaagaagccgaagaagacaggcaag

SEQ ID NO: 442 - DNA, 33 bp, Artificial Sequence
  Synthetic
cttgcctgtcttcttcggcttcttcaaggcggg

SEQ ID NO: 443 - DNA, 2499 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtttaccgggcggaggatcccttggaggccttgcgggggcttggggaggtgagggggcttttggccaaggacctggcggtgctggccctgagggaagggattgccctggcaccgggcgacgaccccatgctcctcgcctacctcctggatccttccaacaccgcccccgaaggggtagcccggcgctacgggggggagtggaccgaggaggcgggggaaagggcgctgctttccgaaaggctttacgccgccctcctgaagcggcttaagggggaggagaggcttctttggctttacgaggaggtggaaaagcccctttcgcgggtcctggcccacatggaggccacgggggtacggttggatgtggcctacttaaaggccctttccctggaggtggaggcggagataaggcgcttcgaggaggaggtccaccgcctggccgggcatcctttcaacctgaactcccgggaccagctggaaagggtcatctttgacgagcttgggcttcccgccatcaagaagacgaggaagacgggcaagcgctccaccagcgccgccgttttggaggccttgcgggaggctcatcccatcgtggaccgcatccttcagtaccgggagctttccaagctcaagggaacctacatcgatcccttgcctgccctggtccaccccaagacgaaccgcctccacacccgtttcaaccagacggccaccgccacggggaggcttagcagctcggatcctaatctgcaaaatatccccgtgcgcacccctttgggccagcggatccgccgggccttcgtggccgaggaggggtggaggctggtggttttggactacagccagattgagctcagggtcctggcgcacctttccggggacgagaacctaatccgggtcttccaggagggccaggacatccacacccagacggccagctggatgttcggcgtgcccccagaggccgtggattccctgatgcgccgggcggccaagaccatcaacttcggcgtcctctacggcatgtccgcccaccggctttcgggagagctggccatcccctacgaggaggcggtggccttcatcgagcggtatttccagagctaccccaaggtgcgggcctggattgagaaaaccctggcggaaggacgggaacggggctatgtggaaaccctctttggccgccggcgctacgtgcccgacttggcttcccgggtgaagagcatccgggaggcagcggagcgcatggccttcaacatgccggtccaggggaccgccgcggatttgatgaaactggccatggtgaagctctttcccaggcttcaggagctgggggccaggatgcttttgcaggtgcacaacgaactggtcctcgaggctcccaaggagcaagcggaggaagtcgcccaggaggccaagcggaccatggaggaggtgtggcccctgaaggtgcccttggaggtggaagtgggcatcggggaggactggctttccgccaaggcc

SEQ ID NO: 444 - protein, 833 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVYRAEDPLEALRGLGEVRGLLAKDLAVLALREGIALAPGDDPMLLAYLLDPSNTAPEGVARRYGGEWTEEAGERALLSERLYAALLKRLKGEERLLWLYEEVEKPLSRVLAHMEATGVRLDVAYLKALSLEVEAEIRRFEEEVHRLAGHPFNLNSRDQLERVIFDELGLPAIKKTRKTGKRSTSAAVLEALREAHPIVDRILQYRELSKLKGTYIDPLPALVHPKTNRLHTRFNQTATATGRLSSSDPNLQNIPVRTPLGQRIRRAFVAEEGWRLVVLDYSQIELRVLAHLSGDENLIRVFQEGQDIHTQTASWMFGVPPEAVDSLMRRAAKTINFGVLYGMSAHRLSGELAIPYEEAVAFIERYFQSYPKVRAWIEKTLAEGRERGYVETLFGRRRYVPDLASRVKSIREAAERMAFNMPVQGTAADLMKLAMVKLFPRLQELGARMLLQVHNELVLEAPKEQAEEVAQEAKRTMEEVWPLKVPLEVEVGIGEDWLSAKA

SEQ ID NO: 445 - DNA, 2496 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcaacaagcccggttgaggccctggccgacctcaaggaggcccgggggttcctggccaaggacctggccgttttggccctgcgggagggggtggccctggaccccacggacgaccccctcctggtggcctacctcctggacccggccaacacccaccccgagggggtggcccggcgctacgggggcgagttcacggaggacgcagcggagagggccctcctctccgagaggctcttccagaacctctttaaacggctttccgagaagctcctctggctctaccaggaggtggagcggcccctctcccgggtcttggcccacatggaggcccggggggtgaggctggacgtcccccttctggaggccctctcctttgagctggagaaggagatggagcgcctggagggggaggtcttccgtttggccggccaccccttcaacctcaactcccgcgaccagctggaaagggtcctctttgacgagctgggcctcaccccggtgaagcggacgaagaagacgggcaagcgctccaccgcccagggggccctggaggccctccggggggcccaccccatcgtggagctcatcctccagtaccgggagctttccaagctcaaaagcacctacctggaccccctgccccggctcgtccacccgcggacgggccggctccacacccgcttcaaccagacggccacggccacgggaaggctttccagctccgaccccaacctgcagaacatccccgtgcgcacccccttggggcagcgcatccgcaaggccttcgtggccgaggaggggtggctccttttggcggcggactactcccagattgagctccgggtcctggcccacctctcgggggacgagaacctgaagcgggtcttccgggaggggaaggacatccataccgagaccgccgcctggatgttcggcttagaccccgctctggtggatccaaagatgcgccgggcggccaagacggtcaacttcggcgtcctctacgggatgtccgcccacaggctctcccaggagctcggcatagactacaaggaggcggaggcctttattgagcgctacttccagagcttccccaaggtgcgggcctggatagaaaggaccctggaggagggccggacgcggggctacgtggagaccctgttcggcaggaggcgctatgtgcccgacctggcctcccgggtccgctcggtgcgggaggcggcggagcggatggccttcaacatgcccgtgcagggcaccgccgccgacctgatgaagatcgccatggtcaagctcttccccaggctaaagcccctgggggcccacctcctcctccaagtggccaacgagctggtcctggaggtgcccgaggaccgggccgaggaggccaaggccctggtcaaggaggtcatggagaacgcctaccccctggacgtgcccctcgaggtggaggtgggcgtgggtcgggactggctggaggcgaagcaggat

SEQ ID NO: 446 - protein, 832 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRATSPVEALADLKEARGFLAKDLAVLALREGVALDPTDDPLLVAYLLDPANTHPEGVARRYGGEFTEDAAERALLSERLFQNLFKRLSEKLLWLYQEVERPLSRVLAHMEARGVRLDVPLLEALSFELEKEMERLEGEVFRLAGHPFNLNSRDQLERVLFDELGLTPVKRTKKTGKRSTAQGALEALRGAHPIVELILQYRELSKLKSTYLDPLPRLVHPRTGRLHTRFNQTATATGRLSSSDPNLQNIPVRTPLGQRIRKAFVAEEGWLLLAADYSQIELRVLAHLSGDENLKRVFREGKDIHTETAAWMFGLDPALVDPKMRRAAKTVNFGVLYGMSAHRLSQELGIDYKEAEAFIERYFQSFPKVRAWIERTLEEGRTRGYVETLFGRRRYVPDLASRVRSVREAAERMAFNMPVQGTAADLMKIAMVKLFPRLKPLGAHLLLQVANELVLEVPEDRAEEAKALVKEVMENAYPLDVPLEVEVGVGRDWLEAKQD

SEQ ID NO: 447 - DNA, 2508 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtttaccgggcggaggatcccttggaggccttgcgggggcttggggaggtgagggggcttttggccaaggacctggcggtgctggccctgagggaagggattgccctggcaccgggcgacgaccccatgctcctcgcctacctcctggatccttccaacaccgcccccgaaggggtagcccggcgctacgggggggagtggaccgaggaggcgggggaaagggcgctgctttccgaaaggctttacgccgccctcctgaagcggcttaagggggaggagaggcttctttggctttacgaggaggtggaaaagcccctttcgcgggtcctggcccacatggaggccacgggggtacggttggatgtggcctacttaaaggccctttccctggaggtggaggcggagataaggcgcttcgaggaggaggtccaccgcctggccgggcatcctttcaacctgaactcccgggaccagctggaaagggtcatctttgacgagcttgggcttcccgccatcaagaagacgaggaagacgggcaagcgctccaccagcgccgccgttttggaggccttgcgggaggctcatcccatcgtggaccgcatccttcagtaccgggagctttccaagctcaagggaacctacatcgatcccttgcctgccctggtccaccccaagacgaaccgcctccacacccgtttcaaccagacggccaccgccacggggaggcttagcagctcggatcctaatctgcaaaatatccccgtgcgcacccctttgggccagcggatccgccgggccttcgtggccgaggaggggtggaggctggtggttttggactacagccagattgagctcagggtcctggcgcacctttccggggacgagaacctaatccgggtcttccaggagggccaggacatccacacccagacggccagctggatgttcggcgtgcccccagaggccgtggattccctgatgcgccgggcggccaagaccatcaacttcggcgtcctctacggcatgtccgcccaccggctttcgggagagctggccatcccctacgaggaggcggtggccttcatcgagcggtatttccagagctaccccaaggtgcgggcctggattgagaaaaccctggcggaaggacgggaacggggctatgtggaaaccctctttggccgccggcgctacgtgcccgacttggcttcccgggtgaagagcatccgggaggcagcggagcgcatggccttcaacatgccggtccaggggaccgccgcggatttgatgaaactggccatggtgaagctctttcccaggcttcaggagctgggggccaggatgcttttgcaggtgcacaacgaactggtcctcgaggctcccaaggagcaagcggaggaagtcgcccaggaggccaagcggaccatggaggaggtgtggcccctgaaggtgcccttggaggtggaagtgggcatcggggaggactggctttccgccaaggcc

SEQ ID NO: 448 - protein, 836 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVYRAEDPLEALRGLGEVRGLLAKDLAVLALREGIALAPGDDPMLLAYLLDPSNTAPEGVARRYGGEWTEEAGERALLSERLYAALLKRLKGEERLLWLYEEVEKPLSRVLAHMEATGVRLDVAYLKALSLEVEAEIRRFEEEVHRLAGHPFNLNSRDQLERVIFDELGLPAIKKTRKTGKRSTSAAVLEALREAHPIVDRILQYRELSKLKGTYIDPLPALVHPKTNRLHTRFNQTATATGRLSSSDPNLQNIPVRTPLGQRIRRAFVAEEGWRLVVLDYSQIELRVLAHLSGDENLIRVFQEGQDIHTQTASWMFGVPPEAVDSLMRRAAKTINFGVLYGMSAHRLSGELAIPYEEAVAFIERYFQSYPKVRAWIEKTLAEGRERGYVETLFGRRRYVPDLASRVKSIREAAERMAFNMPVQGTAADLMKLAMVKLFPRLQELGARMLLQVHNELVLEAPKEQAEEVAQEAKRTMEEVWPLKVPLEVEVGIGEDWLSAKA

SEQ ID NO: 449 - DNA, 2505 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtccaccgggcaacaagcccggttgaggccctggccgacctcaaggaggcccgggggttcctggccaaggacctggccgttttggccctgcgggagggggtggccctggaccccacggacgaccccctcctggtggcctacctcctggacccggccaacacccaccccgagggggtggcccggcgctacgggggcgagttcacggaggacgcagcggagagggccctcctctccgagaggctcttccagaacctctttaaacggctttccgagaagctcctctggctctaccaggaggtggagcggcccctctcccgggtcttggcccacatggaggcccggggggtgaggctggacgtcccccttctggaggccctctcctttgagctggagaaggagatggagcgcctggagggggaggtcttccgtttggccggccaccccttcaacctcaactcccgcgaccagctggaaagggtcctctttgacgagctgggcctcaccccggtgaagcggacgaagaagacgggcaagcgctccaccgcccagggggccctggaggccctccggggggcccaccccatcgtggagctcatcctccagtaccgggagctttccaagctcaaaagcacctacctggaccccctgccccggctcgtccacccgcggacgggccggctccacacccgcttcaaccagacggccacggccacgggaaggctttccagctccgaccccaacctgcagaacatccccgtgcgcacccccttggggcagcgcatccgcaaggccttcgtggccgaggaggggtggctccttttggcggcggactactcccagattgagctccgggtcctggcccacctctcgggggacgagaacctgaagcgggtcttccgggaggggaaggacatccataccgagaccgccgcctggatgttcggcttagaccccgctctggtggatccaaagatgcgccgggcggccaagacggtcaacttcggcgtcctctacgggatgtccgcccacaggctctcccaggagctcggcatagactacaaggaggcggaggcctttattgagcgctacttccagagcttccccaaggtgcgggcctggatagaaaggaccctggaggagggccggacgcggggctacgtggagaccctgttcggcaggaggcgctatgtgcccgacctggcctcccgggtccgctcggtgcgggaggcggcggagcggatggccttcaacatgcccgtgcagggcaccgccgccgacctgatgaagatcgccatggtcaagctcttccccaggctaaagcccctgggggcccacctcctcctccaagtggccaacgagctggtcctggaggtgcccgaggaccgggccgaggaggccaaggccctggtcaaggaggtcatggagaacgcctaccccctggacgtgcccctcgaggtggaggtgggcgtgggtcgggactggctggaggcgaagcaggat

SEQ ID NO: 450 - protein, 835 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRATSPVEALADLKEARGFLAKDLAVLALREGVALDPTDDPLLVAYLLDPANTHPEGVARRYGGEFTEDAAERALLSERLFQNLFKRLSEKLLWLYQEVERPLSRVLAHMEARGVRLDVPLLEALSFELEKEMERLEGEVFRLAGHPFNLNSRDQLERVLFDELGLTPVKRTKKTGKRSTAQGALEALRGAHPIVELILQYRELSKLKSTYLDPLPRLVHPRTGRLHTRFNQTATATGRLSSSDPNLQNIPVRTPLGQRIRKAFVAEEGWLLLAADYSQIELRVLAHLSGDENLKRVFREGKDIHTETAAWMFGLDPALVDPKMRRAAKTVNFGVLYGMSAHRLSQELGIDYKEAEAFIERYFQSFPKVRAWIERTLEEGRTRGYVETLFGRRRYVPDLASRVRSVREAAERMAFNMPVQGTAADLMKIAMVKLFPRLKPLGAHLLLQVANELVLEVPEDRAEEAKALVKEVMENAYPLDVPLEVEVGVGRDWLEAKQD

SEQ ID NO: 451 - DNA, 24 bp, Artificial Sequence
  Synthetic
cttctctcatccgccaaaacagcc

SEQ ID NO: 452 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcatcgtggtctttgacgccgaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 453 - DNA, 18 bp, Artificial Sequence
  Synthetic
ctcctccacgagttcggc

SEQ ID NO: 454 - DNA, 2514 bp, Artificial Sequence
  Synthetic
atgaattccctgcccctctttgagcccaagggccgggtgcttctggtggacggccaccacctggcctaccgtaccttttttgccctgaagggcctcaccaccagccgcggggagccggtccaggcggtgtacgggtttgccaagagccttttgaaggcgctaagggaagacggggatgtggtgatcgtggtgtttgacgccaaggccccctccttccgccaccagacctacgaggcctacaaggcggggcgggctcccacccccgaggactttccccggcagcttgcccttatcaaggagatggtggaccttttgggctttacccgcctcgaggtgccgggctttgaagcggatgacgtcctggctaccctggccaagaaggcggaaaaggaaggctacgaagtgcgcatcctcaccgcggaccgggacctttaccagcttctttcggagcgaatctccatccttcacccggagggttacctgatcaccccggagtggctttgggagaagtatgggcttaagccttcccagtgggtggactaccgggccttggccggggacccttccgacaacatccccggcgtgaagggcatcggggagaagacggcggccaagctgatccgggagtggggaagcctggaaaaccttcttaagcacctggaacaggtgaaacctgcctccgtgcgggagaagatccttagccacatggaggacctcaagctatccctggagctatcccgggtgcacacggacttgctccttcaggtggacttcgcccggcgccgggagccggaccgggaggggcttaaggcctttttggagaggctggagttcggaagcctcctccacgagttcggcctgttggaaagcccggtggcggcggaggaagctccctggccgccccccgagggagccttcgtggggtacgttctttcccgccccgagcccatgtgggcggagcttaacgccttggccgccgcctggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 455 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcatcgtggtctttgacgccgaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtatgggcttaagccttcccagtgggtggactaccgggccttggccggggacccttccgacaacatccccggcgtgaagggcatcggggagaagacggcggccaagctgatccgggagtggggaagcctggaaaaccttcttaagcacctggaacaggtgaaacctgcctccgtgcgggagaagatccttagccacatggaggacctcaagctatccctggagctatcccgggtgcacacggacttgctccttcaggtggacttcgcccggcgccgggagccggaccgggaggggcttaaggcctttttggagaggctggagttcggaagcctcctccacgagttcggcctgttggaaagcccggtggcggcggaggaagctccctggccgccccccgagggagccttcgtggggtacgttctttcccgccccgagcccatgtgggcggagcttaacgccttggccgccgcctggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 456 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVIVVFDAEAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLKPSQWVDYRALAGDPSDNIPGVKGIGEKTAAKLIREWGSLENLLKHLEQVKPASVREKILSHMEDLKLSLELSRVHTDLLLQVDFARRREPDREGLKAFLERLEFGSLLHEFGLLESPVAAEEAPWPPPEGAFVGYVLSRPEPMWAELNALAAAWGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 457 - DNA, 27 bp, Artificial Sequence
  Synthetic
ttccaggtgcttgaggaggttttccag

SEQ ID NO: 458 - DNA, 27 bp, Artificial Sequence
  Synthetic
ctcctcaagcacctggaacaggtgaaa

SEQ ID NO: 459 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcatcgtggtctttgacgccgaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagcacctggaacaggtgaaacctgcctccgtgcgggagaagatccttagccacatggaggacctcaagctatccctggagctatcccgggtgcacacggacttgctccttcaggtggacttcgcccggcgccgggagccggaccgggaggggcttaaggcctttttggagaggctggagttcggaagcctcctccacgagttcggcctgttggaaagcccggtggcggcggaggaagctccctggccgccccccgagggagccttcgtggggtacgttctttcccgccccgagcccatgtgggcggagcttaacgccttggccgccgcctggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 460 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVIVVFDAEAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKHLEQVKPASVREKILSHMEDLKLSLELSRVHTDLLLQVDFARRREPDREGLKAFLERLEFGSLLHEFGLLESPVAAEEAPWPPPEGAFVGYVLSRPEPMWAELNALAAAWGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 461 - DNA, 27 bp, Artificial Sequence
  Synthetic
gtccaggttcttgaggaggttttccag

SEQ ID NO: 462 - DNA, 27 bp, Artificial Sequence
  Synthetic
ctcctcaagaacctggaccgggtaaag

SEQ ID NO: 463 - DNA, 2532 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcatcgtggtctttgacgccgaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccggactcgctccggcgcaagatagaggcgcacctcgaggacctccacctctccttagacctggcccgcatccgcaccgacctccccctggaggtggactttaaggccctgcgccgcaggacccccgacctggagggcctgagggcctttttggaggagctggagttcggaagcctcctccacgagttcggcctcctgggaggggagaagccccgggaggaggccccctggcccccgcccgaaggggccttcgtgggcttcctcctttcccgcaaggagcccatgtgggcggagcttctggccctggcggcggcctcgggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 464 - protein, 844 aa, Artificial Sequence
  Synthetic
MNSEAMLPLFEPKGRVLLVDGHHLAYRTFFALKGLTTSRGEPVQAVYGFAKSLLKALKEDGYKAVIVVFDAEAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPDSLRRKIEAHLEDLHLSLDLARIRTDLPLEVDFKALRRRTPDLEGLRAFLEELEFGSLLHEFGLLGGEKPREEAPWPPPEGAFVGFLLSRKEPMWAELLALAAASGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 465 - DNA, 27 bp, Artificial Sequence
  Synthetic
gacgtccttcggggtgatgaggtggcc

SEQ ID NO: 466 - DNA, 27 bp, Artificial Sequence
  Synthetic
atcaccccgaaggacgtccaggagaag

SEQ ID NO: 467 - DNA, 2532 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcatcgtggtctttgacgccgaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccgaaggacgtccaggagaagtacggggtgcccccggagcgctgggtggacttccgcgccctcacgggggaccgctcggacaacatccccggggtggcggggataggggagaagaccgcccttcgactcctcgcagagtgggggagcgtggaaaacctcctgaagaacctggaccgggtaaagccggactcgctccggcgcaagatagaggcgcacctcgaggacctccacctctccttagacctggcccgcatccgcaccgacctccccctggaggtggactttaaggccctgcgccgcaggacccccgacctggagggcctgagggcctttttggaggagctggagttcggaagcctcctccacgagttcggcctcctgggaggggagaagccccgggaggaggccccctggcccccgcccgaaggggccttcgtgggcttcctcctttcccgcaaggagcccatgtgggcggagcttctggccctggcggcggcctcgggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 468 - protein, 844 aa, Artificial Sequence
  Synthetic
MNSEAMLPLFEPKGRVLLVDGHHLAYRTFFALKGLTTSRGEPVQAVYGFAKSLLKALKEDGYKAVIVVFDAEAPSFRHEAYEAYKAGRAPTPEDFPRQLALIKELVDLLGFTRLEVPGYEADDVLATLAKKAEKEGYEVRILTADRDLYQLVSDRVAVLHPEGHLITPKDVQEKYGVPPERWVDFRALTGDRSDNIPGVAGIGEKTALRLLAEWGSVENLLKNLDRVKPDSLRRKIEAHLEDLHLSLDLARIRTDLPLEVDFKALRRRTPDLEGLRAFLEELEFGSLLHEFGLLGGEKPREEAPWPPPEGAFVGFLLSRKEPMWAELLALAAASGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 469 - DNA, 27 bp, Artificial Sequence
  Synthetic
ctcgaggcgggtaaaccccaggaggtc

SEQ ID NO: 470 - DNA, 27 bp, Artificial Sequence
  Synthetic
gggtttacccgcctcgaggtgcccggc

SEQ ID NO: 471 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcatcgtggtctttgacgccgaggccccctccttccgccacgaggcctacgaggcctacaaggcggggagggccccgacccccgaggacttcccccggcagctcgccctcatcaaggagctggtggacctcctggggtttacccgcctcgaggtgccgggctttgaagcggatgacgtcctggctaccctggccaagaaggcggaaaaggaaggctacgaagtgcgcatcctcaccgcggaccgggacctttaccagcttctttcggagcgaatctccatccttcacccggagggttacctgatcaccccggagtggctttgggagaagtatgggcttaagccttcccagtgggtggactaccgggccttggccggggacccttccgacaacatccccggcgtgaagggcatcggggagaagacggcggccaagctgatccgggagtggggaagcctggaaaaccttcttaagcacctggaacaggtgaaacctgcctccgtgcgggagaagatccttagccacatggaggacctcaagctatccctggagctatcccgggtgcacacggacttgctccttcaggtggacttcgcccggcgccgggagccggaccgggaggggcttaaggcctttttggagaggctggagttcggaagcctcctccacgagttcggcctgttggaaagcccggtggcggcggaggaagctccctggccgccccccgagggagccttcgtggggtacgttctttcccgccccgagcccatgtgggcggagcttaacgccttggccgccgcctggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 472 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVIVVFDAEAPSFRHEAYEAYKAGRAPTPEDFPRQLALIKELVDLLGFTRLEVPGFEADDVLATLAKKAEKEGYEVRILTADRDLYQLLSERISILHPEGYLITPEWLWEKYGLKPSQWVDYRALAGDPSDNIPGVKGIGEKTAAKLIREWGSLENLLKHLEQVKPASVREKILSHMEDLKLSLELSRVHTDLLLQVDFARRREPDREGLKAFLERLEFGSLLHEFGLLESPVAAEEAPWPPPEGAFVGYVLSRPEPMWAELNALAAAWGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 473 - DNA, 27 bp, Artificial Sequence
  Synthetic
aagccactccggggtgatcaggtaacc

SEQ ID NO: 474 - DNA, 27 bp, Artificial Sequence
  Synthetic
atcaccccggagtggctttgggagaag

SEQ ID NO: 475 - DNA, 2514 bp, Artificial Sequence
  Synthetic
atgaattccctgcccctctttgagcccaagggccgggtgcttctggtggacggccaccacctggcctaccgtaccttttttgccctgaagggcctcaccaccagccgcggggagccggtccaggcggtgtacgggtttgccaagagccttttgaaggcgctaagggaagacggggatgtggtgatcgtggtctttgacgccgaggccccctccttccgccaccagacctacgaggcctacaaggcggggcgggctcccacccccgaggactttccccggcagcttgcccttatcaaggagatggtggaccttttgggcctggagcgcctcgaggtgccgggctttgaagcggatgacgtcctggctaccctggccaagaaggcggaaaaggaaggctacgaagtgcgcatcctcaccgcggaccgggacctttaccagcttctttcggagcgaatctccatccttcacccggagggttacctgatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 476 - protein, 838 aa, Artificial Sequence
  Synthetic
MNSLPLFEPKGRVLLVDGHHLAYRTFFALKGLTTSRGEPVQAVYGFAKSLLKALREDGDVVIVVFDAEAPSFRHQTYEAYKAGRAPTPEDFPRQLALIKEMVDLLGLERLEVPGFEADDVLATLAKKAEKEGYEVRILTADRDLYQLLSERISILHPEGYLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 477 - DNA, 64 bp, Artificial Sequence
  Synthetic
caccaccaccaccaccacgtcgactagtgctagcgtcgactagctgcaggcatgcaagcttggc

SEQ ID NO: 478 - DNA, 64 bp, Artificial Sequence
  Synthetic
gccaagcttgcatgcctgcagctagtcgacgctagcactagtcgacgtggtggtggtggtggtg

SEQ ID NO: 479 - DNA, 41 bp, Artificial Sequence
  Synthetic
caggaagcggccgcgtcgacatgaccatgattacgccaagc

SEQ ID NO: 480 - DNA, 42 bp, Artificial Sequence
  Synthetic
gggcccgccagggtcgactcagggcgatggcccactacgtga

SEQ ID NO: 481 - DNA, 3135 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccacgtcgacatgaccatgattacgccaagctatttaggtgacactatagaatactcaagctatgcatcaagcttggtaccgagctcggatccactagtaacggccgccagtgtgctggaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagagctttacggcacctcgaccgcaaaaaacttgatttgggtgatggttcacgtagtgggccatcgccc

SEQ ID NO: 482 - protein, 1045 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHHVDMTMITPSYLGDTIEYSSYASSLVPSSDPLVTAASVLEFCRYPSHWRPLEHASRGPNSPYSESYYNSLAVVLQRRDWENPGVTQLNRLAAHPPFASWRNSEEARTDRPSQQLRSLNGEWDAPCSGALSAAGVVVTRSVTATLASALAPAPFAFFPSFLATFAGFPRQALNRGLPLGFRFRALRHLDRKKLDLGDGSRSGPSP

SEQ ID NO: 483 - DNA, 36 bp, Artificial Sequence; identical to SEQ ID NO: 304
  Synthetic

SEQ ID NO: 484 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 485 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 486 - DNA, 36 bp, Artificial Sequence
  Synthetic
gtggaccttctgggctttacccgcctcgaggccccg

SEQ ID NO: 487 - DNA, 36 bp, Artificial Sequence
  Synthetic
cggggcctcgaggcgggtaaagcccagaaggtccac

SEQ ID NO: 488 - protein, 842 aa, Artificial Sequence
  Synthetic
MNSTPLFDLEEPPKRVLLVDGHHLAYRTFYALSLTTSRGEPVQMVYGFARSLLKALKEDGQAVVVVFDAKAPSFRHEAYEAYKAGRAPTPEDFPRQLALVKRLVDLLGFTRLEAPGYEADDVLGTLAKKAEREGMEVRILTGDRDFFQLLSEKVSVLLPDGTLVTPKDVQEKYGVPPERWVDFRALTGDRSDNIPGVAGIGEKTALRLLAEWGSVENLLKNLDRVKPDSLRRKIEAHLEDLHLSLDLARIRTDLPLEVDFKALRRRTPDLEGLRAFLEELEFGSLLHEFGLLGGEKPREEAPWPPPEGAFVGFLLSRKEPMWAELLALAAASGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 489 - DNA, 24 bp, Artificial Sequence
  Synthetic
tttacccgcctcgaggtgccgggc

SEQ ID NO: 490 - DNA, 36 bp, Artificial Sequence
  Synthetic
cggcacctcgaggcgggtaaagcccaaaaggtccac

SEQ ID NO: 491 - protein, 838 aa, Artificial Sequence
  Synthetic
MNSLPLFEPKGRVLLVDGHHLAYRTFFALKGLTTSRGEPVQAVYGFAKSLLKALREDGDVVIVVFDAKAPSFRHQTYEAYKAGRAPTPEDFPRQLALIKEMVDLLGFTRLEVPGFEADDVLATLAKKAEKEGYEVRILTADRDLYQLLSERISILHPEGYLITPEWLWEKYGLKPSQWVDYRALAGDPSDNIPGVKGIGEKTAAKLIREWGSLENLLKHLEQVKPASVREKILSHMEDLKLSLELSRVHTDLLLQVDFARRREPDREGLKAFLERLEFGSLLHEFGLLESPVAAEEAPWPPPEGAFVGYVLSRPEPMWAELNALAAAWGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 492 - DNA, 34 bp, Artificial Sequence
  Synthetic
atcgtggtctttgacgccgaggccccctccttcc

SEQ ID NO: 493 - DNA, 34 bp, Artificial Sequence
  Synthetic
ggaaggagggggcctcggcgtcaaagaccacgat

SEQ ID NO: 494 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAEAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 495 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccgaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 496 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAEAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 497 - DNA, 2526 bp, Artificial Sequence
  Synthetic
atgaattccaccccactttttgacctggaggaaccccccaagcgggtgcttctggtggacggccaccacctggcctaccgcaccttctatgccctgagcctcaccacctcccggggggagccggtgcagatggtctacggcttcgcccggagcctcctcaaggccttgaaggaggacggacaggcggtggtcgtggtctttgacgccgaggccccctccttccgccacgaggcctacgaggcctacaaggcgggccgggcccccaccccggaggacttcccccgccagctcgccttggtcaagcggctggtggaccttctgggcctggtccgcctcgaggccccggggtacgaggcggacgacgtcctgggcaccctggccaagaaggccgaaagggaggggatggaggtgcgcatcctcacgggagaccgggacttcttccagctcctctccgagaaggtctcggtcctcctgccggacgggaccctggtcaccccaaaggacgtccaggagaagtacggggtgcccccggagcgctgggtggacttccgcgccctcacgggggaccgctcggacaacatccccggggtggcggggataggggagaagaccgcccttcgactcctcgcagagtgggggagcgtggaaaacctcctgaagaacctggaccgggtaaagccggactcgctccggcgcaagatagaggcgcacctcgaggacctccacctctccttagacctggcccgcatccgcaccgacctccccctggaggtggactttaaggccctgcgccgcaggacccccgacctggagggcctgagggcctttttggaggagctggagttcggaagcctcctccacgagttcggcctcctgggaggggagaagccccgggaggaggccccctggcccccgcccgaaggggccttcgtgggcttcctcctttcccgcaaggagcccatgtgggcggagcttctggccctggcggcggcctcgggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 498 - protein, 842 aa, Artificial Sequence
  Synthetic
MNSTPLFDLEEPPKRVLLVDGHHLAYRTFYALSLTTSRGEPVQMVYGFARSLLKALKEDGQAVVVVFDAEAPSFRHEAYEAYKAGRAPTPEDFPRQLALVKRLVDLLGLVRLEAPGYEADDVLGTLAKKAEREGMEVRILTGDRDFFQLLSEKVSVLLPDGTLVTPKDVQEKYGVPPERWVDFRALTGDRSDNIPGVAGIGEKTALRLLAEWGSVENLLKNLDRVKPDSLRRKIEAHLEDLHLSLDLARIRTDLPLEVDFKALRRRTPDLEGLRAFLEELEFGSLLHEFGLLGGEKPREEAPWPPPEGAFVGFLLSRKEPMWAELLALAAASGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 499 - DNA, 2514 bp, Artificial Sequence
  Synthetic
atgaattccctgcccctctttgagcccaagggccgggtgcttctggtggacggccaccacctggcctaccgtaccttttttgccctgaagggcctcaccaccagccgcggggagccggtccaggcggtgtacgggtttgccaagagccttttgaaggcgctaagggaagacggggatgtggtgatcgtggtctttgacgccgaggccccctccttccgccaccagacctacgaggcctacaaggcggggcgggctcccacccccgaggactttccccggcagcttgcccttatcaaggagatggtggaccttttgggcctggagcgcctcgaggtgccgggctttgaagcggatgacgtcctggctaccctggccaagaaggcggaaaaggaaggctacgaagtgcgcatcctcaccgcggaccgggacctttaccagcttctttcggagcgaatctccatccttcacccggagggttacctgatcaccccggagtggctttgggagaagtatgggcttaagccttcccagtgggtggactaccgggccttggccggggacccttccgacaacatccccggcgtgaagggcatcggggagaagacggcggccaagctgatccgggagtggggaagcctggaaaaccttcttaagcacctggaacaggtgaaacctgcctccgtgcgggagaagatccttagccacatggaggacctcaagctatccctggagctatcccgggtgcacacggacttgctccttcaggtggacttcgcccggcgccgggagccggaccgggaggggcttaaggcctttttggagaggctggagttcggaagcctcctccacgagttcggcctgttggaaagcccggtggcggcggaggaagctccctggccgccccccgagggagccttcgtggggtacgttctttcccgccccgagcccatgtgggcggagcttaacgccttggccgccgcctggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 500 - protein, 838 aa, Artificial Sequence
  Synthetic
MNSLPLFEPKGRVLLVDGHHLAYRTFFALKGLTTSRGEPVQAVYGFAKSLLKALREDGDVVIVVFDAEAPSFRHQTYEAYKAGRAPTPEDFPRQLALIKEMVDLLGLERLEVPGFEADDVLATLAKKAEKEGYEVRILTADRDLYQLLSERISILHPEGYLITPEWLWEKYGLKPSQWVDYRALAGDPSDNIPGVKGIGEKTAAKLIREWGSLENLLKHLEQVKPASVREKILSHMEDLKLSLELSRVHTDLLLQVDFARRREPDREGLKAFLERLEFGSLLHEFGLLESPVAAEEAPWPPPEGAFVGYVLSRPEPMWAELNALAAAWGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 501 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccgaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 502 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAEAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 503 - DNA, 34 bp, Artificial Sequence; identical to SEQ ID NO: 492
  Synthetic

SEQ ID NO: 504 - DNA, 34 bp, Artificial Sequence; identical to SEQ ID NO: 493
  Synthetic

SEQ ID NO: 505 - DNA, 2520 bp, Artificial Sequence
  Synthetic
atgaattcggaggcgatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccgaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 506 - protein, 840 aa, Artificial Sequence
  Synthetic
MNSEAMLPLFEPKGRVLLVDGHHLAYRTFHALKGLTTSRGEPVQAVYGFAKSLLKALKEDGDAVIVVFDAEAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 507 - DNA, 36 bp, Artificial Sequence
  Synthetic
cagaccatgaattcggaggcgatgctgcccctcttt

SEQ ID NO: 508 - DNA, 36 bp, Artificial Sequence
  Synthetic
aaagaggggcagcatcgcctccgaattcatggtctg

SEQ ID NO: 509 - DNA, 2517 bp, Artificial Sequence
  Synthetic
atgaattcggggatgctgcccctctttgagcccaagggccgggtcctcctggtggacggccaccacctggcctaccgcaccttctttgccctgaagggcctcaccaccagccggggggagccggtgcaggcggtctacggcttcgccaagagcctcctcaaggccctcaaggaggacggggacgcggtgatcgtggtctttgacgccgaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 510 - protein, 839 aa, Artificial Sequence
  Synthetic
MNSGMLPLFEPKGRVLLVDGHHLAYRTFFALKGLTTSRGEPVQAVYGFAKSLLKALKEDGDAVIVVFDAEAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 511 - DNA, 33 bp, Artificial Sequence
  Synthetic
gcctaccgcaccttctttgccctgaagggcctc

SEQ ID NO: 512 - DNA, 33 bp, Artificial Sequence
  Synthetic
gaggcccttcagggcaaagaaggtgcggtaggc

SEQ ID NO: 513 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcagagaggacggggacgcggtgatcgtggtctttgacgccgaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 514 - protein, 839 aa, Artificial Sequence
  Synthetic
MNSGMLPLFEPKGRVLLVDGHHLAYRTFHALKGLTTSRGEPVQAVYGFAKSLLKALREDGDAVIVVFDAEAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 515 - DNA, 33 bp, Artificial Sequence
  Synthetic
ctcctcaaggccctcagagaggacggggacgcg

SEQ ID NO: 516 - DNA, 33 bp, Artificial Sequence
  Synthetic
cgcgtccccgtcctctctgagggccttgaggag

SEQ ID NO: 517 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccgaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccaccctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 518 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAEAPSFRHEAYGGYKAGRAPTPEDFPRQLALIKELVDLLGFTRLEVPGYEADDVLATLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 519 - DNA, 33 bp, Artificial Sequence
  Synthetic
gacgacgtcctggccaccctggccaagaaggcg

SEQ ID NO: 520 - DNA, 33 bp, Artificial Sequence
  Synthetic
cgccttcttggccagggtggccaggacgtcgtc

SEQ ID NO: 521 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccgaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgctcaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 522 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAEAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVKGIGEKTALKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 523 - DNA, 33 bp, Artificial Sequence
  Synthetic
ggggagaagacggcgctcaagcttctggaggag

SEQ ID NO: 524 - DNA, 33 bp, Artificial Sequence
  Synthetic
ctcctccagaagcttgagcgccgtcttctcccc

SEQ ID NO: 525 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccgaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggaggggcttaaggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 526 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAEAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDREGLKAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 527 - DNA, 39 bp, Artificial Sequence
  Synthetic
gagcccgaccgggaggggcttaaggcctttctggagagg

SEQ ID NO: 528 - DNA, 39 bp, Artificial Sequence
  Synthetic
cctctccagaaaggccttaagcccctcccggtcgggctc

SEQ ID NO: 529 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccgaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctgggaggggagaagccccgggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 530 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAEAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLGGEKPREEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 531 - DNA, 54 bp, Artificial Sequence
  Synthetic
cacgagttcggccttctgggaggggagaagccccgggaggaggccccctggccc

SEQ ID NO: 532 - DNA, 54 bp, Artificial Sequence
  Synthetic
gggccagggggcctcctcccggggcttctcccctcccagaaggccgaactcgtg

SEQ ID NO: 533 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccgaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 534 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAEAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 535 - DNA, 33 bp, Artificial Sequence
  Synthetic
ctggccctggccgcctgcaggggcggccgcgtg

SEQ ID NO: 536 - DNA, 33 bp, Artificial Sequence
  Synthetic
cacgcggccgcccctgcaggcggccagggccag

SEQ ID NO: 537 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccgaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctgaaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 538 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAEAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVKGIGEKTARKLLKEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 539 - DNA, 42 bp, Artificial Sequence
  Synthetic
ggggagaagacggcgaggaagcttctgaaggagtgggggagc

SEQ ID NO: 540 - DNA, 42 bp, Artificial Sequence
  Synthetic
gctcccccactccttcagaagcttcctcgccgtcttctcccc

SEQ ID NO: 541 - DNA, 2520 bp, Artificial Sequence
  Synthetic
atgaattcggaggcgatgctgcccctctttgagcccaagggccgggtcctcctggtggacggccaccacctggcctaccgcaccttctttgccctgaagggcctcaccaccagccggggggagccggtgcaggcggtctacggcttcgccaagagcctcctcaaggccctcagagaggacggggacgcggtgatcgtggtctttgacgccgaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccaccctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgctcaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggaggggcttaaggcctttctggagaggcttgagtttggcagcctcctccacgagttcggccttctgggaggggagaagccccgggaggaggccccctggcccccgccggaaggggccttcgtgggctttgtgctttcccgcaaggagcccatgtgggccgatcttctggccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 542 - protein, 840 aa, Artificial Sequence
  Synthetic
MNSEAMLPLFEPKGRVLLVDGHHLAYRTFFALKGLTTSRGEPVQAVYGFAKSLLKALREDGDAVIVVFDAEAPSFRHEAYGGYKAGRAPTPEDFPRQLALIKELVDLLGFTRLEVPGYEADDVLATLAKKAEKEGYEVRILTADKDLYQLLSDRIHVLHPEGYLITPAWLWEKYGLRPDQWADYRALTGDESDNLPGVKGIGEKTALKLLEEWGSLEALLKNLDRLKPAIREKILAHMDDLKLSWDLAKVRTDLPLEVDFAKRREPDREGLKAFLERLEFGSLLHEFGLLGGEKPREEAPWPPPEGAFVGFVLSRKEPMWADLLALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 543 - DNA, 2520 bp, Artificial Sequence
  Synthetic
atgaattcggaggcgatgctgcccctctttgagcccaagggccgggtcctcctggtggacggccaccacctggcctaccgcaccttctttgccctgaagggcctcaccaccagccggggggagccggtgcaggcggtctacggcttcgccaagagcctcctcaaggccctcagagaggacggggacgcggtgatcgtggtctttgacgccgaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccaccctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgctcaagcttctgaaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggaggggcttaaggcctttctggagaggcttgagtttggcagcctcctccacgagttcggccttctgggaggggagaagccccgggaggaggccccctggcccccgccggaaggggccttcgtgggctttgtgctttcccgcaaggagcccatgtgggccgatcttctggccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 544 - protein, 840 aa, Artificial Sequence; identical to SEQ ID NO: 221
  Synthetic

SEQ ID NO: 545 - DNA, 50 bp, Artificial Sequence
  Synthetic
ggggagaagacggcgctcaggcttctgaaggagtgggggagcctggaagc

SEQ ID NO: 546 - DNA, 50 bp, Artificial Sequence
  Synthetic
gcttccaggctcccccactccttcagaagcttgagcgccgtcttctcccc

SEQ ID NO: 547 - DNA, 33 bp, Artificial Sequence
  Synthetic
ctggtcgggacggacgccaatgagggtgtgaag

SEQ ID NO: 548 - DNA, 18 bp, Artificial Sequence
  Synthetic
gtccgtcccgaccagaat

SEQ ID NO: 549 - DNA, 1008 bp, Artificial Sequence
  Synthetic
atgggtgcggatattggtgacctctttgagagggaagaggtcgagcttgagtacttctcaggaaagaaaattgccgttgatgctttcaacacgctataccagttcatctcgataataaggcagcctgacggtacgccgttaaaggactcacagggcagaatcacctctcacctttccggaatcctatacagagtctccaacatggtcgaggtgggaatcaggccggtgtttgtattcgacggagagccaccggagttcaagaaggctgaaattgaggagaggaaaaagagaagggctgaggcagaggagatgtggattgcggctttgcaggcaggagataaggacgcgaaaaagtatgctcaggctgcagggagggttgacgagtacattgttgactccgcaaagacgcttttaagttacatggggattccctttgtcgatgccccgtctgaaggagaggcgcaggctgcttacatggcagcaaaaggcgatgtggagtacacaggaagccaggattacgattctctgctcttcggaagcccgagactcgccagaaatctcgcaataacgggaaaaaggaagcttcccggcaaaaatgtctatgtggatgtaaagccggagataataattctggaaagcaacctcaaaaggctgggtttgacgagggagcagctcatcgacatagcgattctggtcgggacggacgccaatgagggtgtgaagggtgtcggcgtcaagaaggctttgaactacatcaagacctacggagatattttcagggcactcaaggctctgaaagtaaatattgaccacgtagaggagataaggaatttcttcctgaatcctcctgtgactgacgactacagaatagagttcagggagcctgactttgagaaggccatcgagttcctgtgcgaggagcacgacttcagcagggagagggtcgagaaggccttggagaagctcaaagctctgaagtcaacccaggccacgcttgagaggtggttc

SEQ ID NO: 550 - protein, 336 aa, Artificial Sequence
  Synthetic
MGADIGDLFEREEVELEYFSGKKIAVDAFNTLYQFISIIRQPDGTPLKDSQGRITSHLSGILYRVSNMVEVGIRPVFVFDGEPPEFKKAEIEERKKRRAEAEEMWIAALQAGDKDAKKYAQAAGRVDEYIVDSAKTLLSYMGIPFVDAPSEGEAQAAYMAAKGDVEYTGSQDYDSLLFGSPRLARNLAITGKRKLPGKNVYVDVKPEIIILESNLKRLGLTREQLIDIAILVGTDANEGVKGVGVKKALNYIKTYGDIFRALKALKVNIDHVEEIRNFFLNPPVTDDYRIEFREPDFEKAIEFLCEEHDFSRERVEKALEKLKALKSTQATLERWF

SEQ ID NO: 551 - DNA, 33 bp, Artificial Sequence
  Synthetic
ctggtcgggacggacaggaatgagggtgtgaag

SEQ ID NO: 552 - DNA, 1008 bp, Artificial Sequence
  Synthetic
atgggtgcggatattggtgacctctttgagagggaagaggtcgagcttgagtacttctcaggaaagaaaattgccgttgatgctttcaacacgctataccagttcatctcgataataaggcagcctgacggtacgccgttaaaggactcacagggcagaatcacctctcacctttccggaatcctatacagagtctccaacatggtcgaggtgggaatcaggccggtgtttgtattcgacggagagccaccggagttcaagaaggctgaaattgaggagaggaaaaagagaagggctgaggcagaggagatgtggattgcggctttgcaggcaggagataaggacgcgaaaaagtatgctcaggctgcagggagggttgacgagtacattgttgactccgcaaagacgcttttaagttacatggggattccctttgtcgatgccccgtctgaaggagaggcgcaggctgcttacatggcagcaaaaggcgatgtggagtacacaggaagccaggattacgattctctgctcttcggaagcccgagactcgccagaaatctcgcaataacgggaaaaaggaagcttcccggcaaaaatgtctatgtggatgtaaagccggagataataattctggaaagcaacctcaaaaggctgggtttgacgagggagcagctcatcgacatagcgattctggtcgggacggacaggaatgagggtgtgaagggtgtcggcgtcaagaaggctttgaactacatcaagacctacggagatattttcagggcactcaaggctctgaaagtaaatattgaccacgtagaggagataaggaatttcttcctgaatcctcctgtgactgacgactacagaatagagttcagggagcctgactttgagaaggccatcgagttcctgtgcgaggagcacgacttcagcagggagagggtcgagaaggccttggagaagctcaaagctctgaagtcaacccaggccacgcttgagaggtggttc

SEQ ID NO: 553 - protein, 336 aa, Artificial Sequence
  Synthetic
MGADIGDLFEREEVELEYFSGKKIAVDAFNTLYQFISIIRQPDGTPLKDSQGRITSHLSGILYRVSNMVEVGIRPVFVFDGEPPEFKKAEIEERKKRRAEAEEMWIAALQAGDKDAKKYAQAAGRVDEYIVDSAKTLLSYMGIPFVDAPSEGEAQAAYMAAKGDVEYTGSQDYDSLLFGSPRLARNLAITGKRKLPGKNVYVDVKPEIIILESNLKRLGLTREQLIDIAILVGTDRNEGVKGVGVKKALNYIKTYGDIFRALKALKVNIDHVEEIRNFFLNPPVTDDYRIEFREPDFEKAIEFLCEEHDFSRERVEKALEKLKALKSTQATLERWF

SEQ ID NO: 554 - DNA, 20 bp, Artificial Sequence
  Synthetic
gaaccacctctcaagcgtgg

SEQ ID NO: 555 - DNA, 36 bp, Artificial Sequence
  Synthetic
acgcttgagaggtggttcctggaggaggccccctgg

SEQ ID NO: 556 - DNA, 1011 bp, Archaeoglobus fulgidus
atgggtgcggatattggtgacctctttgagagggaagaggtcgagcttgagtacttctcaggaaagaaaattgccgttgatgctttcaacacgctataccagttcatctcgataataaggcagcctgacggtacgccgttaaaggactcacagggcagaatcacctctcacctttccggaatcctatacagagtctccaacatggtcgaggtgggaatcaggccggtgtttgtattcgacggagagccaccggagttcaagaaggctgaaattgaggagaggaaaaagagaagggctgaggcagaggagatgtggattgcggctttgcaggcaggagataaggacgcgaaaaagtatgctcaggctgcagggagggttgacgagtacattgttgactccgcaaagacgcttttaagttacatggggattccctttgtcgatgccccgtctgaaggagaggcgcaggctgcttacatggcagcaaaaggcgatgtggagtacacaggaagccaggattacgattctctgctcttcggaagcccgagactcgccagaaatctcgcaataacgggaaaaaggaagcttcccggcaaaaatgtctatgtggatgtaaagccggagataataattctggaaagcaacctcaaaaggctgggtttgacgagggagcagctcatcgacatagcgattctggtcgggacggactacaatgagggtgtgaagggtgtcggcgtcaagaaggctttgaactacatcaagacctacggagatattttcagggcactcaaggctctgaaagtaaatattgaccacgtagaggagataaggaatttcttcctgaatcctcctgtgactgacgactacagaatagagttcagggagcctgactttgagaaggccatcgagttcctgtgcgaggagcacgacttcagcagggagagggtcgagaaggccttggagaagctcaaagctctgaagtcaacccaggccacgcttgagaggtggttctga

SEQ ID NO: 557 - DNA, 17 bp, Artificial Sequence
  Synthetic
taatctgtatcaggctg

SEQ ID NO: 558 - DNA, 2526 bp, Artificial Sequence; identical to SEQ ID NO: 104
  Synthetic

SEQ ID NO: 559 - DNA, 2643 bp, Artificial Sequence
  Synthetic
atgggtgcggatattggtgacctctttgagagggaagaggtcgagcttgagtacttctcaggaaagaaaattgccgttgatgctttcaacacgctataccagttcatctcgataataaggcagcctgacggtacgccgttaaaggactcacagggcagaatcacctctcacctttccggaatcctatacagagtctccaacatggtcgaggtgggaatcaggccggtgtttgtattcgacggagagccaccggagttcaagaaggctgaaattgaggagaggaaaaagagaagggctgaggcagaggagatgtggattgcggctttgcaggcaggagataaggacgcgaaaaagtatgctcaggctgcagggagggttgacgagtacattgttgactccgcaaagacgcttttaagttacatggggattccctttgtcgatgccccgtctgaaggagaggcgcaggctgcttacatggcagcaaaaggcgatgtggagtacacaggaagccaggattacgattctctgctcttcggaagcccgagactcgccagaaatctcgcaataacgggaaaaaggaagcttcccggcaaaaatgtctatgtggatgtaaagccggagataataattctggaaagcaacctcaaaaggctgggtttgacgagggagcagctcatcgacatagcgattctggtcgggacggactacaatgagggtgtgaagggtgtcggcgtcaagaaggctttgaactacatcaagacctacggagatattttcagggcactcaaggctctgaaagtaaatattgaccacgtagaggagataaggaatttcttcctgaatcctcctgtgactgacgactacagaatagagttcagggagcctgactttgagaaggccatcgagttcctgtgcgaggagcacgacttcagcagggagagggtcgagaaggccttggagaagctcaaagctctgaagtcaacccaggccacgcttgagaggtggttcctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 560 - protein, 881 aa, Artificial Sequence
  Synthetic
MGADIGDLFEREEVELEYFSGKKIAVDAFNTLYQFISIIRQPDGTPLKDSQGRITSHLSGILYRVSNMVEVGIRPVFVFDGEPPEFKKAEIEERKKRRAEAEEMWIAALQAGDKDAKKYAQAAGRVDEYIVDSAKTLLSYMGIPFVDAPSEGEAQAAYMAAKGDVEYTGSQDYDSLLFGSPRLARNLAITGKRKLPGKNVYVDVKPEIIILESNLKRLGLTREQLIDIAILVGTDYNEGVKGVGVKKALNYIKTYGDIFRALKALKVNIDHVEEIRNFFLNPPVTDDYRIEFREPDFEKAIEFLCEEHDFSRERVEKALEKLKALKSTQATLERWFLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 561 - DNA, 21 bp, Artificial Sequence
  Synthetic
ggttgacttcagagctttgag

SEQ ID NO: 562 - DNA, 36 bp, Artificial Sequence
  Synthetic
aaagctctgaagtcaaccctggaggaggccccctgg

SEQ ID NO: 563 - DNA, 2619 bp, Artificial Sequence
  Synthetic
atgggtgcggatattggtgacctctttgagagggaagaggtcgagcttgagtacttctcaggaaagaaaattgccgttgatgctttcaacacgctataccagttcatctcgataataaggcagcctgacggtacgccgttaaaggactcacagggcagaatcacctctcacctttccggaatcctatacagagtctccaacatggtcgaggtgggaatcaggccggtgtttgtattcgacggagagccaccggagttcaagaaggctgaaattgaggagaggaaaaagagaagggctgaggcagaggagatgtggattgcggctttgcaggcaggagataaggacgcgaaaaagtatgctcaggctgcagggagggttgacgagtacattgttgactccgcaaagacgcttttaagttacatggggattccctttgtcgatgccccgtctgaaggagaggcgcaggctgcttacatggcagcaaaaggcgatgtggagtacacaggaagccaggattacgattctctgctcttcggaagcccgagactcgccagaaatctcgcaataacgggaaaaaggaagcttcccggcaaaaatgtctatgtggatgtaaagccggagataataattctggaaagcaacctcaaaaggctgggtttgacgagggagcagctcatcgacatagcgattctggtcgggacggactacaatgagggtgtgaagggtgtcggcgtcaagaaggctttgaactacatcaagacctacggagatattttcagggcactcaaggctctgaaagtaaatattgaccacgtagaggagataaggaatttcttcctgaatcctcctgtgactgacgactacagaatagagttcagggagcctgactttgagaaggccatcgagttcctgtgcgaggagcacgacttcagcagggagagggtcgagaaggccttggagaagctcaaagctctgaagtcaaccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 564 - protein, 873 aa, Artificial Sequence
  Synthetic
MGADIGDLFEREEVELEYFSGKKIAVDAFNTLYQFISIIRQPDGTPLKDSQGRITSHLSGILYRVSNMVEVGIRPVFVFDGEPPEFKKAEIEERKKRRAEAEEMWIAALQAGDKDAKKYAQAAGRVDEYIVDSAKTLLSYMGIPFVDAPSEGEAQAAYMAAKGDVEYTGSQDYDSLLFGSPRLARNLAITGKRKLPGKNVYVDVKPEIIILESNLKRLGLTREQLIDIAILVGTDYNEGVKGVGVKKALNYIKTYGDIFRALKALKVNIDHVEEIRNFFLNPPVTDDYRIEFREPDFEKAIEFLCEEHDFSRERVEKALEKLKALKSTLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 565 - DNA, 2643 bp, Artificial Sequence
  Synthetic
atgggtgcggatattggtgacctctttgagagggaagaggtcgagcttgagtacttctcaggaaagaaaattgccgttgatgctttcaacacgctataccagttcatctcgataataaggcagcctgacggtacgccgttaaaggactcacagggcagaatcacctctcacctttccggaatcctatacagagtctccaacatggtcgaggtgggaatcaggccggtgtttgtattcgacggagagccaccggagttcaagaaggctgaaattgaggagaggaaaaagagaagggctgaggcagaggagatgtggattgcggctttgcaggcaggagataaggacgcgaaaaagtatgctcaggctgcagggagggttgacgagtacattgttgactccgcaaagacgcttttaagttacatggggattccctttgtcgatgccccgtctgaaggagaggcgcaggctgcttacatggcagcaaaaggcgatgtggagtacacaggaagccaggattacgattctctgctcttcggaagcccgagactcgccagaaatctcgcaataacgggaaaaaggaagcttcccggcaaaaatgtctatgtggatgtaaagccggagataataattctggaaagcaacctcaaaaggctgggtttgacgagggagcagctcatcgacatagcgattctggtcgggacggactacaatgagggtgtgaagggtgtcggcgtcaagaaggctttgaactacatcaagacctacggagatattttcagggcactcaaggctctgaaagtaaatattgaccacgtagaggagataaggaatttcttcctgaatcctcctgtgactgacgactacagaatagagttcagggagcctgactttgagaaggccatcgagttcctgtgcgaggagcacgacttcagcagggagagggtcgagaaggccttggagaagctcaaagctctgaagtcaacccaggccacgcttgagaggtggttcctggaggaggccccctggcccccgccggaaggggccttcgtgggcttcgtcctctcccgccccgagcccatgtgggcggagcttaaagccctggccgcctgcaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcaagaagacgcaaaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtcgccaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 566 - protein, 881 aa, Artificial Sequence
  Synthetic
MGADIGDLFEREEVELEYFSGKKIAVDAFNTLYQFISIIRQPDGTPLKDSQGRITSHLSGILYRVSNMVEVGIRPVFVFDGEPPEFKKAEIEERKKRRAEAEEMWIAALQAGDKDAKKYAQAAGRVDEYIVDSAKTLLSYMGIPFVDAPSEGEAQAAYMAAKGDVEYTGSQDYDSLLFGSPRLARNLAITGKRKLPGKNVYVDVKPEIIILESNLKRLGLTREQLIDIAILVGTDYNEGVKGVGVKKALNYIKTYGDIFRALKALKVNIDHVEEIRNFFLNPPVTDDYRIEFREPDFEKAIEFLCEEHDFSRERVEKALEKLKALKSTQATLERWFLEEAPWPPPEGAFVGFVLSRPEPMWAELKALAACRGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLRALSLEVAEEIARLEAEVFRLAGHPFNLNSRDQLERVLFDELGLPAIKKTQKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVANELVLEAPKERAEAVARLAKEVMEGVYPLAVPLEVEVGIGEDWLSAKEHHHHHH

SEQ ID NO: 567 - DNA, 2643 bp, Artificial Sequence
  Synthetic
atgggtgcggatattggtgacctctttgagagggaagaggtcgagcttgagtacttctcaggaaagaaaattgccgttgatgctttcaacacgctataccagttcatctcgataataaggcagcctgacggtacgccgttaaaggactcacagggcagaatcacctctcacctttccggaatcctatacagagtctccaacatggtcgaggtgggaatcaggccggtgtttgtattcgacggagagccaccggagttcaagaaggctgaaattgaggagaggaaaaagagaagggctgaggcagaggagatgtggattgcggctttgcaggcaggagataaggacgcgaaaaagtatgctcaggctgcagggagggttgacgagtacattgttgactccgcaaagacgcttttaagttacatggggattccctttgtcgatgccccgtctgaaggagaggcgcaggctgcttacatggcagcaaaaggcgatgtggagtacacaggaagccaggattacgattctctgctcttcggaagcccgagactcgccagaaatctcgcaataacgggaaaaaggaagcttcccggcaaaaatgtctatgtggatgtaaagccggagataataattctggaaagcaacctcaaaaggctgggtttgacgagggagcagctcatcgacatagcgattctggtcgggacggactacaatgagggtgtgaagggtgtcggcgtcaagaaggctttgaactacatcaagacctacggagatattttcagggcactcaaggctctgaaagtaaatattgaccacgtagaggagataaggaatttcttcctgaatcctcctgtgactgacgactacagaatagagttcagggagcctgactttgagaaggccatcgagttcctgtgcgaggagcacgacttcagcagggagagggtcgagaaggccttggagaagctcaaagctctgaagtcaacccaggccacgcttgagaggtggttcctggaggaggccccctggcccccgccggaaggggccttcgtgggcttcgtcctctcccgccccgagcccatgtgggcggagcttaaagccctggccgcctgcaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgtgggggaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 568 - protein, 881 aa, Artificial Sequence
  Synthetic
MGADIGDLFEREEVELEYFSGKKIAVDAFNTLYQFISIIRQPDGTPLKDSQGRITSHLSGILYRVSNMVEVGIRPVFVFDGEPPEFKKAEIEERKKRRAEAEEMWIAALQAGDKDAKKYAQAAGRVDEYIVDSAKTLLSYMGIPFVDAPSEGEAQAAYMAAKGDVEYTGSQDYDSLLFGSPRLARNLAITGKRKLPGKNVYVDVKPEIIILESNLKRLGLTREQLIDIAILVGTDYNEGVKGVGVKKALNYIKTYGDIFRALKALKVNIDHVEEIRNFFLNPPVTDDYRIEFREPDFEKAIEFLCEEHDFSRERVEKALEKLKALKSTQATLERWFLEEAPWPPPEGAFVGFVLSRPEPMWAELKALAACRGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 569 - DNA, 24 bp, Artificial Sequence
  Synthetic
gagcggataacaatttcacacagg

SEQ ID NO: 570 - DNA, 30 bp, Artificial Sequence
  Synthetic
tgcccggtgcacgcggccgcccctgcaggc

SEQ ID NO: 571 - DNA, 2445 bp, Artificial Sequence
  Synthetic
atgaattccctgcccctctttgagcccaagggccgggtgcttctggtggacggccaccacctggcctaccgtaccttttttgccctgaagggcctcaccaccagccgcggggagccggtccaggcggtgtacgggtttgccaagagccttttgaaggcgctaagggaagacggggatgtggtgatcgtggtgtttgacgccaaggccccctccttccgccaccagacctacgaggcctacaaggcggggcgggctcccacccccgaggactttccccggcagcttgcccttatcaaggagatggtggaccttttgggcctggagcgcctcgaggtgccgggctttgaagcggatgacgtcctggctaccctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagggggagaagccccgggaggaggccccctggcccccgcccgaaggggccttcgtgggcttcctcctttcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 572 - protein, 815 aa, Artificial Sequence
  Synthetic
MNSLPLFEPKGRVLLVDGHHLAYRTFFALKGLTTSRGEPVQAVYGFAKSLLKALREDGDVVIVVFDAKAPSFRHQTYEAYKAGRAPTPEDFPRQLALIKEMVDLLGLERLEVPGFEADDVLATLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDREGEKPREEAPWPPPEGAFVGFLLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 573 - DNA, 2520 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccaccccggaggacttcccccgccagctcgccttggtcaagcggctggtggaccttctgggcctggtccgcctcgaggccccggggtacgaggcggacgacgtcctgggcaccctggccaagaaggccgaaaaggaggggtacgaggtgcgcatcctcaccgccgaccgcgacctctaccaactcgtctccgaccgcatccacgtcctccaccccgaggggtacctcatcaccccggagtggctttgggagaagtatgggcttaagccttcccagtgggtggactaccgggccttggccggggacccttccgacaacatccccggcgtgaagggcatcggggagaagacggcggccaagctgatccgggagtggggaagcctggaaaacctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 574 - protein, 840 aa, Artificial Sequence
  Synthetic
MNSEAMLPLFEPKGRVLLVDGHHLAYRTFFALKGLTTSRGEPVQAVYGFAKSLLKALKEDGDAVIVVFDAKAPSFRHEAYGGYKAGRAPTPEDFPRQLALVKRLVDLLGLVRLEAPGYEADDVLGTLAKKAEKEGYEVRILTADRDLYQLVSDRIHVLHPEGYLITPEWLWEKYGLKPSQWVDYRALAGDPSDNIPGVKGIGEKTAAKLIREWGSLENLLKNLDRLKPAIREKILAHMDDLKLSWDLAKVRTDLPLEVDFAKRREPDRERLRAFLERLEFGSLLHEFGLLESPKALEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 575 - DNA, 2445 bp, Artificial Sequence
  Synthetic
atgaattccctgcccctctttgagcccaagggccgggtgcttctggtggacggccaccacctggcctaccgtaccttttttgccctgaagggcctcaccaccagccgcggggagccggtccaggcggtgtacgggtttgccaagagccttttgaaggcgctaagggaagacggggatgtggtgatcgtggtgtttgacgccaaggccccctccttccgccaccagacctacgaggcctacaaggcggggcgggctcccacccccgaggactttccccggcagcttgcccttatcaaggagatggtggaccttttgggctttacccgcctcgaggtgccgggctttgaagcggatgacgtcctggctaccctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagggggagaagccccgggaggaggccccctggcccccgcccgaaggggccttcgtgggcttcctcctttcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 576 - protein, 815 aa, Artificial Sequence
  Synthetic
MNSLPLFEPKGRVLLVDGHHLAYRTFFALKGLTTSRGEPVQAVYGFAKSLLKALREDGDVVIVVFDAKAPSFRHQTYEAYKAGRAPTPEDFPRQLALIKEMVDLLGFTRLEVPGFEADDVLATLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDREGEKPREEAPWPPPEGAFVGFLLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 577 - DNA, 2520 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccaccccggaggacttcccccgccagctcgccttggtcaagcggctggtggaccttctgggctttacccgcctcgaggccccggggtacgaggcggacgacgtcctgggcaccctggccaagaaggccgaaaaggaggggtacgaggtgcgcatcctcaccgccgaccgcgacctctaccaactcgtctccgaccgcatccacgtcctccaccccgaggggtacctcatcaccccggagtggctttgggagaagtatgggcttaagccttcccagtgggtggactaccgggccttggccggggacccttccgacaacatccccggcgtgaagggcatcggggagaagacggcggccaagctgatccgggagtggggaagcctggaaaacctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 578 - protein, 840 aa, Artificial Sequence
  Synthetic
MNSEAMLPLFEPKGRVLLVDGHHLAYRTFFALKGLTTSRGEPVQAVYGFAKSLLKALKEDGDAVIVVFDAKAPSFRHEAYGGYKAGRAPTPEDFPRQLALVKRLVDLLGFTRLEAPGYEADDVLGTLAKKAEKEGYEVRILTADRDLYQLVSDRIHVLHPEGYLITPEWLWEKYGLKPSQWVDYRALAGDPSDNIPGVKGIGEKTAAKLIREWGSLENLLKNLDRLKPAIREKILAHMDDLKLSWDLAKVRTDLPLEVDFAKRREPDRERLRAFLERLEFGSLLHEFGLLESPKALEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 579 - DNA, 2445 bp, Artificial Sequence
  Synthetic
atgaattccctgcccctctttgagcccaagggccgggtgcttctggtggacggccaccacctggcctaccgtaccttttttgccctgaagggcctcaccaccagccgcggggagccggtccaggcggtgtacgggtttgccaagagccttttgaaggcgctaagggaagacggggatgtggtgatcgtggtctttgacgccgaggccccctccttccgccaccagacctacgaggcctacaaggcggggcgggctcccacccccgaggactttccccggcagcttgcccttatcaaggagatggtggaccttttgggcctggagcgcctcgaggtgccgggctttgaagcggatgacgtcctggctaccctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagggggagaagccccgggaggaggccccctggcccccgcccgaaggggccttcgtgggcttcctcctttcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 580 - protein, 815 aa, Artificial Sequence
  Synthetic
MNSLPLFEPKGRVLLVDGHHLAYRTFFALKGLTTSRGEPVQAVYGFAKSLLKALREDGDVVIVVFDAEAPSFRHQTYEAYKAGRAPTPEDFPRQLALIKEMVDLLGLERLEVPGFEADDVLATLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDREGEKPREEAPWPPPEGAFVGFLLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 581 - DNA, 2445 bp, Artificial Sequence
  Synthetic
atgaattccctgcccctctttgagcccaagggccgggtgcttctggtggacggccaccacctggcctaccgtaccttttttgccctgaagggcctcaccaccagccgcggggagccggtccaggcggtgtacgggtttgccaagagccttttgaaggcgctaagggaagacggggatgtggtgatcgtggtctttgacgccgaggccccctccttccgccaccagacctacgaggcctacaaggcggggcgggctcccacccccgaggactttccccggcagcttgcccttatcaaggagatggtggaccttttgggctttacccgcctcgaggtgccgggctttgaagcggatgacgtcctggctaccctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagggggagaagccccgggaggaggccccctggcccccgcccgaaggggccttcgtgggcttcctcctttcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 582 - protein, 815 aa, Artificial Sequence
  Synthetic
MNSLPLFEPKGRVLLVDGHHLAYRTFFALKGLTTSRGEPVQAVYGFAKSLLKALREDGDVVIVVFDAEAPSFRHQTYEAYKAGRAPTPEDFPRQLALIKEMVDLLGFTRLEVPGFEADDVLATLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDREGEKPREEAPWPPPEGAFVGFLLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 583 - DNA, 2520 bp, Artificial Sequence; identical to SEQ ID NO: 222
  Synthetic

SEQ ID NO: 584 - protein, 840 aa, Artificial Sequence; identical to SEQ ID NO: 221
  Synthetic

SEQ ID NO: 585 - DNA, 2499 bp, Artificial Sequence
  Synthetic
atgaattccctgcccctctttgagcccaagagccgggtgcttctggtggacggccaccacctggcctaccgcacctccttcgccctgaagggcctcaccaccagccgcggggagccggtgcagatggtctacggcttcgcccggagcctcctcaaggccttgaaggaggacggacaggcggtggtcgtggtctttgacgccaaggccccctccttccgccacgaggcctacgaggcctacaaggcgggccgggcccccaccccggaggacttccccggcagctcgcccttatcaaggagatggtggaccttttgggcctggcgcgcctcgaggtcccgggctacgaggcggacgacgttctcgccaccctggccaagaaggcggaaaaggaggggtacgaggtgcgcattctaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggaggagacggcggccaagctgatccgggagtggggaagcctggaaaaccttcttaagcacctggaacaggcgaaacctgcctccgtgcgggagaagatccttagccacatggaggacctcaagctatccctggagctatcccgggtgcacacggacttgcttcttcagtggactttaaggccctgcgccgcaggacccccgacctggagggcctgagggcctttttggaggagctggagttcggcagcctcctccacgagttcggcctcctggaggcccccgccgcggcggaggaagctccctggccgccccccgagggagccttcgtggggtacgttctttcccgccccgagcccatgtgggcggagcttaacgccttggccgccgcctggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggt

SEQ ID NO: 586 - protein, 811 aa, Artificial Sequence
  Synthetic
MEFLPLFEPKGRVLLVDGHHLAYRTFHALKGLTTSRGEPVQAVYGFAKSLLKALREDGDVVIVVFDAKAPSFRHEAYGGYKAGRAPTPEDFPRQLALIKELVDLLGLARLEVPGFEADDVLATLAKKAEKEGYEVRILTGDRDLYQLVSDRVARPEQWVDYRALAGDPSDNIPGVKGIGEKTARKLLEEWGSVEALLKNLDRLKPAIREKILAHMEDLKLSLELSRVRTDLPLEVDLAQGREPDREGLKAFLERLEFGSLLHEFGLLESPVAAEEAPWPPPEGAFVGYVLSRPEPMWAELNALAAAWGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKG

SEQ ID NO: 587 - DNA, 2433 bp, Artificial Sequence
  Synthetic
atggaattcctgcccctctttgagcccaagggccgggtgcttctggtggacggccaccacctggcctaccgcaccttccacgccctgaagggcctcaccaccagccgcggggagccggtccaggcggtgtacgggtttgccaagagccttttgaaggcgctaagagaagacggggatgtggtgatcgtggtctttgacgccaaggccccctccttccgccacgaggcctacggggggtacaaggcgggccgggccccgacccccgaggacttcccccggcagctcgccctcatcaaggagctggtggacctcctggggctggcgcgcctcgaggtgccgggctttgaagcggatgacgtcctggctaccctggccaagaaggcggaaaaggagggctacgaggtgcgcattctcaccggcgaccgcgacctttaccaactcgtctccgaccgcgtcgccaggccggagcagtgggtggactaccgggccttggccggggacccttccgacaacatccccggcgtgaagggcatcggggagaagacggcgaggaagcttctggaggagtgggggagcgtggaagccctcctcaagaacctggaccggctgaagcccgccatccgggagaagatcctggcccacatggaggacctcaagctatccctggagctatcccgggtgcgcaccgacctccccctggaggtggacctcgcccaggggcgggagcccgaccgggaggggcttaaggcctttttggagaggctggagttcggaagcctcctccacgagttcggcctgttggaaagcccggtggcggcggaggaagctccctggccgccccccgagggagccttcgtggggtacgttctttcccgccccgagcccatgtgggcggagcttaacgccttggccgccgcctggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggt

SEQ ID NO: 588 - protein, 811 aa, Artificial Sequence; identical to SEQ ID NO: 586
  Synthetic

SEQ ID NO: 589 - DNA, 2493 bp, Artificial Sequence
  Synthetic
atgaattccctgcccctctttgagcccaagggccgggtcctcctggtggacggccaccacctggcctaccgtaccttttttgccctgaagggcctcaccacctcccggggggagccggtgcagatggtctacggcttcgcccggagcctcctcaaggccctcaaggaggacggggacgcggtgatcgtggtctttgacgccgaggccccctccttccgccaccagacctacgaggcctacaaggcggggagggctcccacccccgaggactttccccggcagcttgcccttatcaaggagctggtggacctcctggggtttacccgcctcgaggtccccggctacgaggcggacgacgttctcgccaccctggccaagaaggcggaaaaggagggctacgaggtgcgcatcctcaccgcggaccgggacctttaccagcttctttccgaccgcattcacgtccttcaccccgaggggtacctcatcaccccggcctggctttgggaaaagtacggcttgaggcccgaccagtgggccgactaccgggccctgaccggggacgaatccgacaacctttccggggtcaagggcatcggggagaagacggcgaggaagcttctggaggagtgggggagcctggaagccctcctcaagaacctggaccggctgaagcccgccatccgggagaagatcctggcccacatggacgatctgaagctctccttggagctctcccgggtgcgcaccgacctccccctggaggtggacttcgccaaaaggcgggagcccgaccgggagaggcttagggcctttctggagaggcttgagtttggcagcctcctccacgagttcggccctttggaaagccccagggccgcggaggaagctccctggccgccccccgagggagccttcgtggggtacgttctttcccgccccgagcccatgtgggcggagcttaacgccttggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggt

SEQ ID NO: 590 - protein, 831 aa, Artificial Sequence
  Synthetic
MNSLPLFEPKGRVLLVDGHHLAYRTFFALKGLTTSRGEPVQMVYGFARSLLKALKEDGDAVIVVFDAEAPSFRHQTYEAYKAGRAPTPEDFPRQLALIKELVDLLGFTRLEVPGYEADDVLATLAKKAEKEGYEVRILTADRDLYQLLSDRIHVLHPEGYLITPAWLWEKYGLRPDQWADYRALTGDESDNLSGVKGIGEKTARKLLEEWGSLEALLKNLDRLKPAIREKILAHMDDLKLSLELSRVRTDLPLEVDFAKRREPDRERLRAFLERLEFGSLLHEFGPLESPRAAEEAPWPPPEGAFVGYVLSRPEPMWAELNALAAARGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKG

SEQ ID NO: 591 - DNA, 23 bp, Artificial Sequence
  Synthetic
agaaaggaagggaagaaagcgaa

SEQ ID NO: 592 - DNA, 45 bp, Artificial Sequence
  Synthetic
tggaggtcaaaacatcgataagtcgaagaaaggaagggaagaaat

SEQ ID NO: 593 - DNA, 14 bp, Artificial Sequence
  Synthetic
tgttttgacctcca

SEQ ID NO: 594 - DNA, 20 bp, Artificial Sequence
  Synthetic
ggcgaccacacccgtcctgt

SEQ ID NO: 595 - DNA, 20 bp, Artificial Sequence
  Synthetic
ccacgatgcgtccggcgtag

SEQ ID NO: 596 - DNA, 26 bp, Artificial Sequence
  Synthetic
acgggtcaatgtccatgccccaaaga

SEQ ID NO: 597 - DNA, 41 bp, Artificial Sequence
  Synthetic
  modified_base (23)..(23): /note= "The residue at this position indicates 2' o-methyl sugar"
gtctgagatgaaagtgctcccgcacccacccaaggcacagc

SEQ ID NO: 598 - DNA, 26 bp, Artificial Sequence
  Synthetic
tcttcgcacatttcatctcagacgga

SEQ ID NO: 599 - DNA, 17 bp, Artificial Sequence
  Synthetic
  modified_base (1)..(17): /note= "The residues at these positions are 2' o-methyl sugars"
gctgtgccttgggtggg

SEQ ID NO: 600 - DNA, 21 bp, Artificial Sequence
  Synthetic
  modified_base (1)..(21): /note= "The residues at these positions are 2' o-methyls"
gctgtgccttgggtgggtgcg

SEQ ID NO: 601 - DNA, 28 bp, Artificial Sequence
  Synthetic
aacgaggcgcacccacccaaggcacagc

SEQ ID NO: 602 - DNA, 27 bp, Artificial Sequence
  Synthetic
  modified_base (23)..(27): /note= "The residues at these positions are 2' o-methyls"
gtctgagatgaaagtgcgcctcgttaa

SEQ ID NO: 603 - DNA, 28 bp, Artificial Sequence
  Synthetic
aacgaggcgcacccacccaaggcacagc

SEQ ID NO: 604 - DNA, 23 bp, Artificial Sequence
  Synthetic
tcttcgcacatttcatctcagac

SEQ ID NO: 605 - DNA, 21 bp, Artificial Sequence
  Synthetic
gctgtgccttgggtgggtgcg

SEQ ID NO: 606 - DNA, 26 bp, Artificial Sequence
  Synthetic
tcttcgcacatttcatctcagacgga

SEQ ID NO: 607 - DNA, 20 bp, Artificial Sequence
  Synthetic
gctgtgccttgggtgggtgc

SEQ ID NO: 608 - DNA, 20 bp, Artificial Sequence
  Synthetic
  modified_base (15)..(20): /note= "The residues at these positions are 2' o-methyl sugars"
gctgtgccttgggtgggtgc

SEQ ID NO: 609 - DNA, 20 bp, Artificial Sequence
  Synthetic
  modified_base (1)..(20): /note= "The residues at these positions are 2' o-methyl sugars"
gctgtgccttgggtgggtgc

SEQ ID NO: 610 - DNA, 26 bp, Artificial Sequence
  Synthetic
acgggtcaatgtccatgccccaaaga

SEQ ID NO: 611 - DNA, 28 bp, Artificial Sequence
  Synthetic
aacgaggcgcacccacccaaggcacagc

SEQ ID NO: 612 - DNA, 27 bp, Artificial Sequence
  Synthetic
  modified_base (23)..(27): /note= "The residues at these positions are 2' o-methyls"
gtctgagatgaaagtgcgcctcgttaa

SEQ ID NO: 613 - DNA, 17 bp, Artificial Sequence
  Synthetic
  modified_base (1)..(17): /note= "The residues at these positions are 2' o-methyls"
gctgtgccttgggtggg

SEQ ID NO: 614 - DNA, 19 bp, Artificial Sequence
  Synthetic
  modified_base (1)..(19): /note= "The residues at these positions are 2' o-methyls"
gctgtgccttgggtgggtg

SEQ ID NO: 615 - DNA, 21 bp, Artificial Sequence
  Synthetic
  modified_base (1)..(21): /note= "The residues at these positions are 2' o-methyls"
gctgtgccttgggtgggtgcg

SEQ ID NO: 616 - DNA, 22 bp, Artificial Sequence
  Synthetic
  modified_base (1)..(22): /note= "The residues at these positions are 2' o-methyls"
gctgtgccttgggtgggtgcgc

SEQ ID NO: 617 - DNA, 26 bp, Artificial Sequence
  Synthetic
ccgtcaacatttaccatgggtgcgga

SEQ ID NO: 618 - DNA, 31 bp, Artificial Sequence
  Synthetic
ccgccacctcgtagtcgacatccttttcgtg

SEQ ID NO: 619 - DNA, 29 bp, Artificial Sequence
  Synthetic
ttgataaatttggggtggaaaggtttgga

SEQ ID NO: 620 - DNA, 17 bp, Artificial Sequence
  Synthetic
agaactgagaggaggcg

SEQ ID NO: 621 - DNA, 25 bp, Artificial Sequence
  Synthetic
aacgaggcgcaccaaactcactcat

SEQ ID NO: 622 - DNA, 35 bp, Artificial Sequence
  Synthetic
gtcatgtaggcttctatgtagttgatgaagatgta

SEQ ID NO: 623 - DNA, 26 bp, Artificial Sequence
  Synthetic
ggctttgtagatgcctttctcttgga

SEQ ID NO: 624 - DNA, 18 bp, Artificial Sequence
  Synthetic
atgagtgagtttggtgcg

SEQ ID NO: 625 - DNA, 27 bp, Artificial Sequence
  Synthetic
ccaggaagcaagtggtgcgcctcgttt

SEQ ID NO: 626 - DNA, 22 bp, Artificial Sequence
  Synthetic
aacgaggcgcaccttggaggca

SEQ ID NO: 627 - DNA, 24 bp, Artificial Sequence
  Synthetic
aaggtttccttctcagttgtgtta

SEQ ID NO: 628 - DNA, 26 bp, Artificial Sequence
  Synthetic
gcaaagatgtctgttacggtcaactc

SEQ ID NO: 629 - DNA, 16 bp, Artificial Sequence
  Synthetic
tgcctccaaggtgcgc

SEQ ID NO: 630 - DNA, 27 bp, Artificial Sequence
  Synthetic
aacgaggcgcaccttcaaaatgcctaa

SEQ ID NO: 631 - DNA, 23 bp, Artificial Sequence
  Synthetic
tgtcactctcctctttccaatta

SEQ ID NO: 632 - DNA, 29 bp, Artificial Sequence
  Synthetic
gaaaagagttccattatccgctacatctg

SEQ ID NO: 633 - DNA, 21 bp, Artificial Sequence
  Synthetic
ttaggcattttgaaggtgcgc

SEQ ID NO: 634 - DNA, 23 bp, Artificial Sequence
  Synthetic
aacgaggcgcaccgttgtgtccc

SEQ ID NO: 635 - DNA, 21 bp, Artificial Sequence
  Synthetic
gggatgtagaagccattcaga

SEQ ID NO: 636 - DNA, 20 bp, Artificial Sequence
  Synthetic
ttgttgtgctgtgggggatg

SEQ ID NO: 637 - DNA, 17 bp, Artificial Sequence
  Synthetic
gggacacaacggtgcgc

SEQ ID NO: 638 - DNA, 23 bp, Artificial Sequence
  Synthetic
ccgtcacgcctccaccatatccc

SEQ ID NO: 639 - DNA, 27 bp, Artificial Sequence
  Synthetic
ccagcggtttccattggcaaagatcaa

SEQ ID NO: 640 - DNA, 21 bp, Artificial Sequence
  Synthetic
cggaagaatgggtcgaccatg

SEQ ID NO: 641 - DNA, 17 bp, Artificial Sequence
  Synthetic
gggatatggtggaggcg

SEQ ID NO: 642 - DNA, 22 bp, Artificial Sequence
  Synthetic
aacgaggcgcaccgttccaggc

SEQ ID NO: 643 - DNA, 24 bp, Artificial Sequence
  Synthetic
catatccatgcagcaccaccatga

SEQ ID NO: 644 - DNA, 25 bp, Artificial Sequence
  Synthetic
caaaatacagagtgaacacagggcc

SEQ ID NO: 645 - DNA, 16 bp, Artificial Sequence
  Synthetic
gcctggaacggtgcgc

SEQ ID NO: 646 - DNA, 25 bp, Artificial Sequence
  Synthetic
ccgtcacgcctcatggataatgccc

SEQ ID NO: 647 - DNA, 33 bp, Artificial Sequence
  Synthetic
caggtgagaaaaggcattacagatagtgaaagc

SEQ ID NO: 648 - DNA, 22 bp, Artificial Sequence
  Synthetic
cagaggaaagagagctgcaggg

SEQ ID NO: 649 - DNA, 19 bp, Artificial Sequence
  Synthetic
gggcattatccatgaggcg

SEQ ID NO: 650 - DNA, 24 bp, Artificial Sequence
  Synthetic
ccgtcacgcctccctgctgagaaa

SEQ ID NO: 651 - DNA, 20 bp, Artificial Sequence
  Synthetic
cccgaggcatgcacggcgga

SEQ ID NO: 652 - DNA, 15 bp, Artificial Sequence
  Synthetic
ggcaggaaggcctcc

SEQ ID NO: 653 - DNA, 18 bp, Artificial Sequence
  Synthetic
tttctcagcagggaggcg

SEQ ID NO: 654 - DNA, 20 bp, Artificial Sequence
  Synthetic
ccgtcacgcctcgccccaca

SEQ ID NO: 655 - DNA, 28 bp, Artificial Sequence
  Synthetic
cagcacaggctgttgaccatcataaaac

SEQ ID NO: 656 - DNA, 25 bp, Artificial Sequence
  Synthetic
cttttccatactttttatgacattc

SEQ ID NO: 657 - DNA, 14 bp, Artificial Sequence
  Synthetic
tgtggggcgaggcg

SEQ ID NO: 658 - DNA, 23 bp, Artificial Sequence
  Synthetic
aacgaggcgcacagttgaccttc

SEQ ID NO: 659 - DNA, 19 bp, Artificial Sequence
  Synthetic
gtgatggccagcacagggc

SEQ ID NO: 660 - DNA, 20 bp, Artificial Sequence
  Synthetic
atacgttccccacatttttc

SEQ ID NO: 661 - DNA, 18 bp, Artificial Sequence
  Synthetic
tgaaggtcaactgtgcgc

SEQ ID NO: 662 - DNA, 26 bp, Artificial Sequence
  Synthetic
aacgaggcgcacgtcataaatacccc

SEQ ID NO: 663 - DNA, 21 bp, Artificial Sequence
  Synthetic
gccagcataggctgttgacac

SEQ ID NO: 664 - DNA, 28 bp, Artificial Sequence
  Synthetic
agacttttctatactttttataacattc

SEQ ID NO: 665 - DNA, 20 bp, Artificial Sequence
  Synthetic
ggggtatttatgacgtgcgc

SEQ ID NO: 666 - DNA, 23 bp, Artificial Sequence
  Synthetic
ccgtcacgcctcctgtctgtgat

SEQ ID NO: 667 - DNA, 22 bp, Artificial Sequence
  Synthetic
tcctgacagtgctcaatcagga

SEQ ID NO: 668 - DNA, 22 bp, Artificial Sequence
  Synthetic
tcctgacaatgctcaatgagga

SEQ ID NO: 669 - DNA, 16 bp, Artificial Sequence
  Synthetic
gtcccggatgtggccc

SEQ ID NO: 670 - DNA, 17 bp, Artificial Sequence
  Synthetic
atcacagacaggaggcg

SEQ ID NO: 671 - DNA, 26 bp, Artificial Sequence
  Synthetic
aacgaggcgcacggactgttttctgc

SEQ ID NO: 672 - DNA, 27 bp, Artificial Sequence
  Synthetic
cttgtcaaagtcctgatagtgctcctc

SEQ ID NO: 673 - DNA, 27 bp, Artificial Sequence
  Synthetic
cttgttgaagtcttgatagtgttcctc

SEQ ID NO: 674 - DNA, 20 bp, Artificial Sequence
  Synthetic
gcagaaaacagtccgtgcgc

SEQ ID NO: 675 - DNA, 23 bp, Artificial Sequence
  Synthetic
ccgtcacgcctcactgcggtcat

SEQ ID NO: 676 - DNA, 31 bp, Artificial Sequence
  Synthetic
gtggataactgcatcagtgtatggcattttc

SEQ ID NO: 677 - DNA, 25 bp, Artificial Sequence
  Synthetic
caagggttggtagcctgtgtgagcc

SEQ ID NO: 678 - DNA, 17 bp, Artificial Sequence
  Synthetic
atgaccgcagtgaggcg

SEQ ID NO: 679 - DNA, 24 bp, Artificial Sequence
  Synthetic
ccgtcacgcctcagagccaatcac

SEQ ID NO: 680 - DNA, 27 bp, Artificial Sequence
  Synthetic
cgatcatcaagggatggtggcctgtgc

SEQ ID NO: 681 - DNA, 31 bp, Artificial Sequence
  Synthetic
ctgatcaatctccttttggactttctctgcg

SEQ ID NO: 682 - DNA, 18 bp, Artificial Sequence
  Synthetic
gtgattggctctgaggcg

SEQ ID NO: 683 - DNA, 26 bp, Artificial Sequence
  Synthetic
ccgtcacgcctcctcttcaatttctg

SEQ ID NO: 684 - DNA, 26 bp, Artificial Sequence
  Synthetic
ccctgtcaatttcttcatgaagttta

SEQ ID NO: 685 - DNA, 23 bp, Artificial Sequence
  Synthetic
ggtatttcatgaggatcaggagc

SEQ ID NO: 686 - DNA, 20 bp, Artificial Sequence
  Synthetic
cagaaattgaagaggaggcg

SEQ ID NO: 687 - DNA, 21 bp, Artificial Sequence
  Synthetic
aacgaggcgcaccgggtccca

SEQ ID NO: 688 - DNA, 30 bp, Artificial Sequence
  Synthetic
tcccctgtttcttgaaaagtccatgtgtga

SEQ ID NO: 689 - DNA, 21 bp, Artificial Sequence
  Synthetic
aatccgtagaggagcaccagg

SEQ ID NO: 690 - DNA, 15 bp, Artificial Sequence
  Synthetic
tgggacccggtgcgc

SEQ ID NO: 691 - DNA, 21 bp, Artificial Sequence
  Synthetic
ccgtcacgcctcctcggcagg

SEQ ID NO: 692 - DNA, 29 bp, Artificial Sequence
  Synthetic
cacaatatcgtaggtaggaggtgccttaa

SEQ ID NO: 693 - DNA, 18 bp, Artificial Sequence
  Synthetic
gccccatcgatctcctcc

SEQ ID NO: 694 - DNA, 15 bp, Artificial Sequence
  Synthetic
cctgccgaggaggcg

SEQ ID NO: 695 - DNA, 23 bp, Artificial Sequence
  Synthetic
aacgaggcgcactaggctttgct

SEQ ID NO: 696 - DNA, 31 bp, Artificial Sequence
  Synthetic
ttcatgtagtcagggtcatagacaattaaga

SEQ ID NO: 697 - DNA, 23 bp, Artificial Sequence
  Synthetic
tccccagaaccatcgaggaaagg

SEQ ID NO: 698 - DNA, 17 bp, Artificial Sequence
  Synthetic
agcaaagcctagtgcgc

SEQ ID NO: 699 - DNA, 24 bp, Artificial Sequence
  Synthetic
aacgaggcgcacagaaggcccctt

SEQ ID NO: 700 - DNA, 31 bp, Artificial Sequence
  Synthetic
ccttgaacagcaccagaaatagactgagcac

SEQ ID NO: 701 - DNA, 23 bp, Artificial Sequence
  Synthetic
ggaagaacccagagacaccatcc

SEQ ID NO: 702 - DNA, 18 bp, Artificial Sequence
  Synthetic
aaggggccttctgtgcgc

SEQ ID NO: 703 - DNA, 25 bp, Artificial Sequence
  Synthetic
aacgaggcgcacgttgtgatacctt

SEQ ID NO: 704 - DNA, 27 bp, Artificial Sequence
  Synthetic
gatgaaggccataaattaaaattgtgc

SEQ ID NO: 705 - DNA, 16 bp, Artificial Sequence
  Synthetic
tgggtatggaacgtcc

SEQ ID NO: 706 - DNA, 19 bp, Artificial Sequence
  Synthetic
aaggtatcacaacgtgcgc

SEQ ID NO: 707 - DNA, 14 bp, Artificial Sequence
  Synthetic
cccccttttggggg

SEQ ID NO: 708 - DNA, 30 bp, Artificial Sequence
  Synthetic
ccctatctttaaagtttttaaaaagtttga

SEQ ID NO: 709 - DNA, 24 bp, Artificial Sequence
  Synthetic
ccgccgagatcactctgactgcct

SEQ ID NO: 710 - DNA, 27 bp, Artificial Sequence
  Synthetic
ttgtcactcggggttcgagaagatgaa

SEQ ID NO: 711 - DNA, 19 bp, Artificial Sequence
  Synthetic
gggccagagggctgattag

SEQ ID NO: 712 - DNA, 18 bp, Artificial Sequence
  Synthetic
gggccagagggctgatta

SEQ ID NO: 713 - DNA, 16 bp, Artificial Sequence
  Synthetic
gggccagagggctgat

SEQ ID NO: 714 - DNA, 13 bp, Artificial Sequence
  Synthetic
gggccagagggct

SEQ ID NO: 715 - DNA, 11 bp, Artificial Sequence
  Synthetic
gggccagaggg

SEQ ID NO: 716 - DNA, 17 bp, Artificial Sequence
  Synthetic
aggcagtcagagtgatc

SEQ ID NO: 717 - DNA, 19 bp, Artificial Sequence
  Synthetic
aggcagtcagagtgatctc

SEQ ID NO: 718 - DNA, 28 bp, Artificial Sequence
  Synthetic
cggaagaagcagttggtgatctcggcgg

SEQ ID NO: 719 - DNA, 14 bp, Artificial Sequence
  Synthetic
  misc_feature (4)..(4): The residue at this position is linked to a spacer bearing a Cy3 dye.
caacgcttcctccg

SEQ ID NO: 720 - DNA, 23 bp, Artificial Sequence
  Synthetic
ccgtcacgcctctctgactgcct

SEQ ID NO: 721 - DNA, 27 bp, Artificial Sequence
  Synthetic
ttgtcactcggggttcgagaagatgaa

SEQ ID NO: 722 - DNA, 19 bp, Artificial Sequence
  Synthetic
gggccagagggctgattag

SEQ ID NO: 723 - DNA, 17 bp, Artificial Sequence
  Synthetic
aggcagtcagagaggcg

SEQ ID NO: 724 - DNA, 28 bp, Artificial Sequence
  Synthetic
cggaagaagcagttggaggcgtgacggt

SEQ ID NO: 725 - DNA, 14 bp, Artificial Sequence
  Synthetic
  misc_feature (4)..(4): The residue at this position is linked to a spacer bearing a Cy3 dye.
caacgcttcctccg

SEQ ID NO: 726 - DNA, 25 bp, Artificial Sequence
  Synthetic
ccgtcacgcctctctgactgcctgg

SEQ ID NO: 727 - DNA, 27 bp, Artificial Sequence
  Synthetic
ttgtcactcggggttcgagaagatgaa

SEQ ID NO: 728 - DNA, 19 bp, Artificial Sequence
  Synthetic
ccaggcagtcagagaggcg

SEQ ID NO: 729 - DNA, 28 bp, Artificial Sequence
  Synthetic
cggaagaagcagttggaggcgtgacggt

SEQ ID NO: 730 - DNA, 14 bp, Artificial Sequence
  Synthetic
  misc_feature (4)..(4): The residue at this position is linked to a spacer bearing a Cy3 dye.
caacgcttcctccg

SEQ ID NO: 731 - DNA, 23 bp, Artificial Sequence
  Synthetic
ccgccgagatcactctgactgcc

SEQ ID NO: 732 - DNA, 27 bp, Artificial Sequence
  Synthetic
ttgtcactcggggttcgagaagatgaa

SEQ ID NO: 733 - DNA, 19 bp, Artificial Sequence
  Synthetic
tgggccagagggctgatta

SEQ ID NO: 734 - DNA, 17 bp, Artificial Sequence
  Synthetic
aggcagtcagagtgatc

SEQ ID NO: 735 - DNA, 28 bp, Artificial Sequence
  Synthetic
cggaagaagcagttggtgatctcggcgg

SEQ ID NO: 736 - DNA, 14 bp, Artificial Sequence
  Synthetic
  misc_feature (4)..(4): The residue at this position is linked to a spacer bearing a Cy3 dye.
caacgcttcctccg

SEQ ID NO: 737 - DNA, 24 bp, Artificial Sequence
  Synthetic
ccgccgagatcactgatctgactg

SEQ ID NO: 738 - DNA, 25 bp, Artificial Sequence
  Synthetic
cttgtcactcggggttcgagaagac

SEQ ID NO: 739 - DNA, 20 bp, Artificial Sequence
  Synthetic
cctgggccagagggctgatt

SEQ ID NO: 740 - DNA, 17 bp, Artificial Sequence
  Synthetic
cagtcagatcagtgatc

SEQ ID NO: 741 - DNA, 28 bp, Artificial Sequence
  Synthetic
cggaagaagcagttggtgatctcggcgg

SEQ ID NO: 742 - DNA, 14 bp, Artificial Sequence
  Synthetic
  misc_feature (4)..(4): The residue at this position is linked to a spacer bearing a Cy3 dye.
caacgcttcctccg

SEQ ID NO: 743 - DNA, 23 bp, Artificial Sequence
  Synthetic
ccgtcacgcctctctgactgcca

SEQ ID NO: 744 - DNA, 23 bp, Artificial Sequence
  Synthetic
ccgtcacgcctctctgactgccg

SEQ ID NO: 745 - DNA, 23 bp, Artificial Sequence
  Synthetic
ccgtcacgcctctctgacggcct

SEQ ID NO: 746 - DNA, 23 bp, Artificial Sequence
  Synthetic
ccgtcacgcctctctgacagcct

SEQ ID NO: 747 - DNA, 27 bp, Artificial Sequence
  Synthetic
ttgtcactcggggttcgagaagatgaa

SEQ ID NO: 748 - DNA, 11 bp, Artificial Sequence
  Synthetic
gggccagaggg

SEQ ID NO: 749 - DNA, 17 bp, Artificial Sequence
  Synthetic
aggcagtcagagaggcg

SEQ ID NO: 750 - DNA, 17 bp, Artificial Sequence
  Synthetic
aggccgtcagagaggcg

SEQ ID NO: 751 - DNA, 17 bp, Artificial Sequence
  Synthetic
aggctgtcagagaggcg

SEQ ID NO: 752 - DNA, 27 bp, Artificial Sequence
  Synthetic
ccaggaagcaagtggaggcgtgacggu

SEQ ID NO: 753 - DNA, 13 bp, Artificial Sequence
  Synthetic
  misc_feature (3)..(3): The residue at this position is linked to a Z21 quenching group.
cactgcttcgtgg

SEQ ID NO: 754 - DNA, 26 bp, Artificial Sequence
  Synthetic
ccgccgagatcactctgatgcctggg

SEQ ID NO: 755 - DNA, 28 bp, Artificial Sequence
  Synthetic
cttgtcactcggggttcgagaagatgaa

SEQ ID NO: 756 - DNA, 20 bp, Artificial Sequence
  Synthetic
cccaggcagtcagagtgatc

SEQ ID NO: 757 - DNA, 28 bp, Artificial Sequence
  Synthetic
cggaggaagcagttggtgatctcggcgg

SEQ ID NO: 758 - DNA, 14 bp, Artificial Sequence
  Synthetic
  misc_feature (4)..(4): The residue at this position is linked to a spacer bearing a Cy3 dye.
caacgcttcctccg

SEQ ID NO: 759 - DNA, 25 bp, Artificial Sequence
  Synthetic
ccgtcacgcctccatctgtttaggg

SEQ ID NO: 760 - DNA, 22 bp, Artificial Sequence
  Synthetic
caggtcctggaaggagcactta

SEQ ID NO: 761 - DNA, 26 bp, Artificial Sequence
  Synthetic
ccatcagcttctttgttcttgtcatc

SEQ ID NO: 762 - DNA, 20 bp, Artificial Sequence
  Synthetic
gccctaaacagatggaggcg

SEQ ID NO: 763 - DNA, 28 bp, Artificial Sequence
  Synthetic
cggaagaagcagttggaggcgtgacggt

SEQ ID NO: 764 - DNA, 14 bp, Artificial Sequence
  Synthetic
  misc_feature (4)..(4): The residue at this position is linked to a spacer bearing a Cy3 dye.
caacgcttcctccg

SEQ ID NO: 765 - DNA, 26 bp, Artificial Sequence
  Synthetic
ccgtcacgcctccatctgtttagggc

SEQ ID NO: 766 - DNA, 22 bp, Artificial Sequence
  Synthetic
caggtcctggaaggagcactta

SEQ ID NO: 767 - DNA, 26 bp, Artificial Sequence
  Synthetic
catcagcttctttgttcttgtcatcc

SEQ ID NO: 768 - DNA, 20 bp, Artificial Sequence
  Synthetic
gccctaaacagatggaggcg

SEQ ID NO: 769 - DNA, 28 bp, Artificial Sequence
  Synthetic
cggaagaagcagttggaggcgtgacggt

SEQ ID NO: 770 - DNA, 14 bp, Artificial Sequence
  Synthetic
caacgcttcctccg

SEQ ID NO: 771 - DNA, 24 bp, Artificial Sequence
  Synthetic
ccgtcacgcctccatctgtttagg

SEQ ID NO: 772 - DNA, 22 bp, Artificial Sequence
  Synthetic
caggtcctggaaggagcactta

SEQ ID NO: 773 - DNA, 27 bp, Artificial Sequence
  Synthetic
gccatcagcttctttgttcttgtcatc

SEQ ID NO: 774 - DNA, 28 bp, Artificial Sequence
  Synthetic
cggaagaagcagttggaggcgtgacggt

SEQ ID NO: 775 - DNA, 14 bp, Artificial Sequence
  Synthetic
  misc_feature (4)..(4): The residue at this position is linked to a spacer bearing a Cy3 dye.
caacgcttcctccg

SEQ ID NO: 776 - DNA, 23 bp, Artificial Sequence
  Synthetic
ccgtcacgcctcccatcagcttc

SEQ ID NO: 777 - DNA, 22 bp, Artificial Sequence
  Synthetic
gagcacttcatctgtttaggga

SEQ ID NO: 778 - DNA, 26 bp, Artificial Sequence
  Synthetic
tttgttcttgtcatcctcattgccac

SEQ ID NO: 779 - DNA, 17 bp, Artificial Sequence
  Synthetic
gaagctgatgggaggcg

SEQ ID NO: 780 - DNA, 28 bp, Artificial Sequence
  Synthetic
cggaagaagcagttggaggcgtgacggt

SEQ ID NO: 781 - DNA, 14 bp, Artificial Sequence
  Synthetic
  misc_feature (4)..(4): The residue at this position is linked to a spacer bearing a Cy3 dye.
caacgcttcctccg

SEQ ID NO: 782 - DNA, 29 bp, Artificial Sequence
  Synthetic
ccgccgagatcactcatctgtttagggcc

SEQ ID NO: 783 - DNA, 28 bp, Artificial Sequence
  Synthetic
ccgccgagatcactcatctgtttagggc

SEQ ID NO: 784 - DNA, 21 bp, Artificial Sequence
  Synthetic
caggtcctggaaggagcacta

SEQ ID NO: 785 - DNA, 22 bp, Artificial Sequence
  Synthetic
ggccctaaacagatgagtgatc

SEQ ID NO: 786 - DNA, 28 bp, Artificial Sequence
  Synthetic
cggaggaagcagttggtgatctcggcgg

SEQ ID NO: 787 - DNA, 14 bp, Artificial Sequence
  Synthetic
  misc_feature (4)..(4): The residue at this position is linked to a spacer bearing a Cy3 dye.
caacgcttcctccg

SEQ ID NO: 788 - DNA, 24 bp, Artificial Sequence
  Synthetic
ccgtcacgcctccagcaggttggc

SEQ ID NO: 789 - DNA, 17 bp, Artificial Sequence
  Synthetic
gcttgacccagggaggg

SEQ ID NO: 790 - DNA, 18 bp, Artificial Sequence
  Synthetic
gccaaggtgctggaggcg

SEQ ID NO: 791 - DNA, 28 bp, Artificial Sequence
  Synthetic
cggaagaagcagttggaggcgtgacggt

SEQ ID NO: 792 - DNA, 14 bp, Artificial Sequence
  Synthetic
  misc_feature (4)..(4): The residue at this position is linked to a spacer bearing a Cy3 dye.
caacgcttcctccg

SEQ ID NO: 793 - DNA, 23 bp, Artificial Sequence
  Synthetic
ccgtcacgcctccagcaggttgg

SEQ ID NO: 794 - DNA, 17 bp, Artificial Sequence
  Synthetic
gcttgacccagggaggg

SEQ ID NO: 795 - DNA, 23 bp, Artificial Sequence
  Synthetic
caatctcggtctgcaaagcagac

SEQ ID NO: 796 - DNA, 18 bp, Artificial Sequence
  Synthetic
gccaaggtgctggaggcg

SEQ ID NO: 797 - DNA, 28 bp, Artificial Sequence
  Synthetic
cggaagaagcagttggaggcgtgacggt

SEQ ID NO: 798 - DNA, 14 bp, Artificial Sequence
  Synthetic
  misc_feature (4)..(4): The residue at this position is linked to a spacer bearing a Cy3 dye.
caacgcttcctccg

SEQ ID NO: 799 - DNA, 24 bp, Artificial Sequence
  Synthetic
ccgtcacgcctctcagcaggttgg

SEQ ID NO: 800 - DNA, 22 bp, Artificial Sequence
  Synthetic
actctagtttttccttctccta

SEQ ID NO: 801 - DNA, 23 bp, Artificial Sequence
  Synthetic
caatctcggtctgcaaagcagac

SEQ ID NO: 802 - DNA, 18 bp, Artificial Sequence
  Synthetic
ccaacctgctgagaggcg

SEQ ID NO: 803 - DNA, 28 bp, Artificial Sequence
  Synthetic
cggaagaagcagttggaggcgtgacggt

SEQ ID NO: 804 - DNA, 14 bp, Artificial Sequence
  Synthetic
  misc_feature (4)..(4): The residue at this position is linked to a spacer bearing a Cy3 dye.
caacgcttcctccg

SEQ ID NO: 805 - DNA, 30 bp, Artificial Sequence
  Synthetic
ccgccgagatcactctcctcattgaatcct

SEQ ID NO: 806 - DNA, 29 bp, Artificial Sequence
  Synthetic
ccgccgagatcactctcctcattgaatcc

SEQ ID NO: 807 - DNA, 34 bp, Artificial Sequence
  Synthetic
ccaaaagtccagtgatgattttcaccaggcaaga

SEQ ID NO: 808 - DNA, 25 bp, Artificial Sequence
  Synthetic
aggattcaatgaggaagagtgatct

SEQ ID NO: 809 - DNA, 28 bp, Artificial Sequence
  Synthetic
cggaggaagcagttggtgatctcggcgg

SEQ ID NO: 810 - DNA, 14 bp, Artificial Sequence
  Synthetic
  misc_feature (4)..(4): The residue at this position is linked to a spacer bearing a Cy3 dye.
caacgcttcctccg

SEQ ID NO: 811 - DNA, 24 bp, Artificial Sequence
  Synthetic
ccgtcacgcctcctcctcattgaa

SEQ ID NO: 812 - DNA, 27 bp, Artificial Sequence
  Synthetic
ccagtgatgattttcaccaggcaagta

SEQ ID NO: 813 - DNA, 22 bp, Artificial Sequence
  Synthetic
tccagattggaagcatccatct

SEQ ID NO: 814 - DNA, 17 bp, Artificial Sequence
  Synthetic
ttcaatgaggaggaggc

SEQ ID NO: 815 - DNA, 28 bp, Artificial Sequence
  Synthetic
cggaagaagcagttggaggcgtgacggt

SEQ ID NO: 816 - DNA, 14 bp, Artificial Sequence
  Synthetic
  misc_feature (4)..(4): The residue at this position is linked to a spacer bearing a Cy3 dye.
caacgcttcctccg

SEQ ID NO: 817 - DNA, 23 bp, Artificial Sequence
  Synthetic
ccgtcacgcctcctcctcattga

SEQ ID NO: 818 - DNA, 27 bp, Artificial Sequence
  Synthetic
ccagtgatgattttcaccaggcaagta

SEQ ID NO: 819 - DNA, 23 bp, Artificial Sequence
  Synthetic
atccagattggaagcatccatct

SEQ ID NO: 820 - DNA, 17 bp, Artificial Sequence
  Synthetic
ttcaatgaggaggaggc

SEQ ID NO: 821 - DNA, 28 bp, Artificial Sequence
  Synthetic
cggaagaagcagttggaggcgtgacggt

SEQ ID NO: 822 - DNA, 14 bp, Artificial Sequence
  Synthetic
  misc_feature (4)..(4): The residue at this position is linked to a spacer bearing a Cy3 dye.
caacgcttcctccg

SEQ ID NO: 823 - DNA, 26 bp, Artificial Sequence
  Synthetic
ccgtcacgcctcctcctcattgaatg

SEQ ID NO: 824 - DNA, 26 bp, Artificial Sequence
  Synthetic
ccgtcacgcctcctcctcattgaata

SEQ ID NO: 825 - DNA, 26 bp, Artificial Sequence
  Synthetic
ccgtcacgcctcctcctcattgaatt

SEQ ID NO: 826 - DNA, 35 bp, Artificial Sequence; identical to SEQ ID NO: 199
  Synthetic

SEQ ID NO: 827 - DNA, 20 bp, Artificial Sequence
  Synthetic
cagattggaagcatccatct

SEQ ID NO: 828 - DNA, 19 bp, Artificial Sequence
  Synthetic
gattcaatgaggaggaggc

SEQ ID NO: 829 - DNA, 27 bp, Artificial Sequence
  Synthetic
ccaggaagcaagtggaggcgtgacggu

SEQ ID NO: 830 - DNA, 13 bp, Artificial Sequence
  Synthetic
  misc_feature (3)..(3): The residue at this position is linked to a Z21 quenching group.
cactgcttcgtgg

SEQ ID NO: 831 - DNA, 26 bp, Artificial Sequence
  Synthetic
ccgtcacgcctccttcggagtttggt

SEQ ID NO: 832 - DNA, 27 bp, Artificial Sequence
  Synthetic
ccgtcacgcctccttcggagtttggtt

SEQ ID NO: 833 - DNA, 25 bp, Artificial Sequence
  Synthetic
gggttgtggagtgagtgttcaagta

SEQ ID NO: 834 - DNA, 24 bp, Artificial Sequence
  Synthetic
aacccaaactccgaaggcggcgtg

SEQ ID NO: 835 - DNA, 28 bp, Artificial Sequence
  Synthetic
cggaagaagcagttggaggcgtgacggt

SEQ ID NO: 836 - DNA, 14 bp, Artificial Sequence
  Synthetic
  misc_feature (4)..(4): The residue at this position is linked to a spacer bearing a Cy3 dye.
caacgcttcctccg

SEQ ID NO: 837 - DNA, 29 bp, Artificial Sequence
  Synthetic
gccgtcacgcctctttgggtttgcttgtc

SEQ ID NO: 838 - DNA, 28 bp, Artificial Sequence
  Synthetic
gccgtcacgcctctttgggtttgcttgt

SEQ ID NO: 839 - DNA, 27 bp, Artificial Sequence
  Synthetic
tggagtgagtgttcaagtcttcggaga

SEQ ID NO: 840 - DNA, 22 bp, Artificial Sequence
  Synthetic
gacaagcaaacccaaagaggcg

SEQ ID NO: 841 - DNA, 28 bp, Artificial Sequence
  Synthetic
cggaagaagcagttggaggcgtgacggc

SEQ ID NO: 842 - DNA, 14 bp, Artificial Sequence
  Synthetic
  misc_feature (4)..(4): The residue at this position is linked to a spacer bearing a Cy3 dye.
caacgcttcctccg

SEQ ID NO: 843 - DNA, 27 bp, Artificial Sequence
  Synthetic
cctgtctcgctgccttcggagtttggg

SEQ ID NO: 844 - DNA, 26 bp, Artificial Sequence
  Synthetic
cctgtctcgctgccttcggagtttgg

SEQ ID NO: 845 - DNA, 25 bp, Artificial Sequence
  Synthetic
gggttgtggagtgagtgttcaagta

SEQ ID NO: 846 - DNA, 20 bp, Artificial Sequence
  Synthetic
cccaaactccgaaggcagcg

SEQ ID NO: 847 - DNA, 28 bp, Artificial Sequence
  Synthetic
cggaggaagcagttggcagcgagacagg

SEQ ID NO: 848 - DNA, 28 bp, Artificial Sequence
  Synthetic
  modified_base (26)..(26): The modified nucleotide at this position is amino-deoxy adenosine .
cggaggaagcagttggcagcgagacagg

SEQ ID NO: 849 - DNA, 28 bp, Artificial Sequence
  Synthetic
  modified_base (22)..(22): The modified nucleotide at this position is amino-deoxy adenosine .
cggaggaagcagttggcagcgagacagg

SEQ ID NO: 850 - DNA, 28 bp, Artificial Sequence
  Synthetic
  modified_base (18)..(18): The modified nucleotide at this position is amino-deoxy adenosine .
cggaggaagcagttggcagcgagacagg

SEQ ID NO: 851 - DNA, 28 bp, Artificial Sequence
  Synthetic
  modified_base (22)..(22): The modified nucleotide at this position is amino-deoxy adenosine .
  modified_base (26)..(26): The modified nucleotide at this position is amino-deoxy adenosine .
cggaggaagcagttggcagcgagacagg

SEQ ID NO: 852 - DNA, 28 bp, Artificial Sequence
  Synthetic
  modified_base (18)..(18): The modified nucleotide at this position is amino-deoxy adenosine .
  modified_base (26)..(26): The modified nucleotide at this position is amino-deoxy adenosine .
cggaggaagcagttggcagcgagacagg

SEQ ID NO: 853 - DNA, 28 bp, Artificial Sequence
  Synthetic
  modified_base (18)..(18): The modified nucleotide at this position is amino-deoxy adenosine .
  modified_base (22)..(22): The modified nucleotide at this position is amino-deoxy adenosine .
cggaggaagcagttggcagcgagacagg

SEQ ID NO: 854 - DNA, 14 bp, Artificial Sequence
  Synthetic
  misc_feature (4)..(4): The residue at this position is linked to a spacer bearing a Cy3 dye.
caacgcttcctccg

SEQ ID NO: 855 - DNA, 28 bp, Artificial Sequence
  Synthetic
gccgtcacgcctctgggacacttgctgc

SEQ ID NO: 856 - DNA, 32 bp, Artificial Sequence
  Synthetic
gccacaatggtcttgaagatcacagcttctta

SEQ ID NO: 857 - DNA, 21 bp, Artificial Sequence
  Synthetic
gcagcaagtgtcccagaggcg

SEQ ID NO: 858 - DNA, 28 bp, Artificial Sequence
  Synthetic
cggaagaagcagttggaggcgtgacggc

SEQ ID NO: 859 - DNA, 14 bp, Artificial Sequence
  Synthetic
  misc_feature (4)..(4): The residue at this position is linked to a spacer bearing a Cy3 dye.
caacgcttcctccg

SEQ ID NO: 860 - DNA, 26 bp, Artificial Sequence
  Synthetic
ccgtcacgcctccttcggagtttggg

SEQ ID NO: 861 - DNA, 25 bp, Artificial Sequence
  Synthetic
gggttgtggagtgagtgttcaagta

SEQ ID NO: 862 - DNA, 20 bp, Artificial Sequence
  Synthetic
gggaaactccgaaggaggcg

SEQ ID NO: 863 - DNA, 27 bp, Artificial Sequence
  Synthetic
ccaggaagcaagtggaggcgtgacggu

SEQ ID NO: 864 - DNA, 13 bp, Artificial Sequence
  Synthetic
  misc_feature (3)..(3): The residue at this position is linked to a Z21 quenching group.
cactgcttcgtgg

SEQ ID NO: 865 - DNA, 26 bp, Artificial Sequence
  Synthetic
cgccgagatcaccttcggagtttggg

SEQ ID NO: 866 - DNA, 25 bp, Artificial Sequence
  Synthetic
gggttgtggagtgagtgttcaagta

SEQ ID NO: 867 - DNA, 20 bp, Artificial Sequence
  Synthetic
cccaaactccgaaggtgatc

SEQ ID NO: 868 - DNA, 28 bp, Artificial Sequence
  Synthetic
cggaagaagcagttggtgatctcggcgg

SEQ ID NO: 869 - DNA, 14 bp, Artificial Sequence
  Synthetic
  misc_feature (4)..(4): The residue at this position is linked to a spacer bearing a Cy3 dye.
caacgcttcctccg

SEQ ID NO: 870 - DNA, 26 bp, Artificial Sequence
  Synthetic
aacgaggcgcaccttcggagtttggg

SEQ ID NO: 871 - DNA, 25 bp, Artificial Sequence
  Synthetic
gggttgtggagtgagtgttcaagta

SEQ ID NO: 872 - DNA, 19 bp, Artificial Sequence
  Synthetic
cccaaactccgaaggtgcg

SEQ ID NO: 873 - DNA, 29 bp, Artificial Sequence
  Synthetic
cggaagaagcagttggtgcgcctcgttaa

SEQ ID NO: 874 - DNA, 14 bp, Artificial Sequence
  Synthetic
  misc_feature (4)..(4): The residue at this position is linked to a spacer bearing a Cy3 dye.
caacgcttcctccg

SEQ ID NO: 875 - DNA, 25 bp, Artificial Sequence
  Synthetic
ccgtcacgcctccttcggagtttgg

SEQ ID NO: 876 - DNA, 25 bp, Artificial Sequence
  Synthetic
gggttgtggagtgagtgttcaagta

SEQ ID NO: 877 - DNA, 18 bp, Artificial Sequence
  Synthetic
gtttgcttgtccaggtgg

SEQ ID NO: 878 - DNA, 19 bp, Artificial Sequence
  Synthetic
ccaaactccgaaggaggcg

SEQ ID NO: 879 - DNA, 28 bp, Artificial Sequence
  Synthetic
cggaagaagcagttggaggcgtgacggt

SEQ ID NO: 880 - DNA, 14 bp, Artificial Sequence
  Synthetic
  misc_feature (4)..(4): The residue at this position is linked to a spacer bearing a Cy3 dye.
caacgcttcctccg

SEQ ID NO: 881 - DNA, 24 bp, Artificial Sequence
  Synthetic
ccgtcacgcctccttcggagtttg

SEQ ID NO: 882 - DNA, 25 bp, Artificial Sequence
  Synthetic
gggttgtggagtgagtgttcaagta

SEQ ID NO: 883 - DNA, 19 bp, Artificial Sequence
  Synthetic
gttttgcttgtccaggtgg

SEQ ID NO: 884 - DNA, 19 bp, Artificial Sequence
  Synthetic
ccaaactccgaaggaggcg

SEQ ID NO: 885 - DNA, 28 bp, Artificial Sequence
  Synthetic
cggaagaagcagttggaggcgtgacggt

SEQ ID NO: 886 - DNA, 14 bp, Artificial Sequence
  Synthetic
  misc_feature (4)..(4): The residue at this position is linked to a spacer bearing a Cy3 dye.
caacgcttcctccg

SEQ ID NO: 887 - DNA, 23 bp, Artificial Sequence
  Synthetic
ccgtcacgcctccttcggagttt

SEQ ID NO: 888 - DNA, 25 bp, Artificial Sequence
  Synthetic
gggttgtggagtgagtgttcaagta

SEQ ID NO: 889 - DNA, 19 bp, Artificial Sequence
  Synthetic
gggtttgcttgtccaggtg

SEQ ID NO: 890 - DNA, 19 bp, Artificial Sequence
  Synthetic
ccaaactccgaaggaggcg

SEQ ID NO: 891 - DNA, 28 bp, Artificial Sequence
  Synthetic
cggaagaagcagttggaggcgtgacggt

SEQ ID NO: 892 - DNA, 14 bp, Artificial Sequence
  Synthetic
  misc_feature (4)..(4): The residue at this position is linked to a spacer bearing a Cy3 dye.
caacgcttcctccg

SEQ ID NO: 893 - DNA, 23 bp, Artificial Sequence
  Synthetic
ccgtcacgcctccggagtttggg

SEQ ID NO: 894 - DNA, 26 bp, Artificial Sequence
  Synthetic
gttgtggagtgagtgttcaagtatta

SEQ ID NO: 895 - DNA, 22 bp, Artificial Sequence
  Synthetic
tttgcttgtccaggtggtccag

SEQ ID NO: 896 - DNA, 17 bp, Artificial Sequence
  Synthetic
cccaaactccggaggcg

SEQ ID NO: 897 - DNA, 28 bp, Artificial Sequence
  Synthetic
cggaagaagcagttggaggcgtgacggt

SEQ ID NO: 898 - DNA, 14 bp, Artificial Sequence
  Synthetic
  misc_feature (4)..(4): The residue at this position is linked to a spacer bearing a Cy3 dye.
caacgcttcctccg

SEQ ID NO: 899 - DNA, 23 bp, Artificial Sequence
  Synthetic
cgccgagatcaccggagtttggg

SEQ ID NO: 900 - DNA, 26 bp, Artificial Sequence
  Synthetic
gttgtggagtgagtgttcaagtatta

SEQ ID NO: 901 - DNA, 22 bp, Artificial Sequence
  Synthetic
tttgcttgtccaggtggtccag

SEQ ID NO: 902 - DNA, 17 bp, Artificial Sequence
  Synthetic
ctagtggcctcaaaccc

SEQ ID NO: 903 - DNA, 28 bp, Artificial Sequence
  Synthetic
cggaagaagcagttggtgatctcggcgg

SEQ ID NO: 904 - DNA, 14 bp, Artificial Sequence
  Synthetic
  misc_feature (4)..(4): The residue at this position is linked to a spacer bearing a Cy3 dye.
caacgcttcctccg

SEQ ID NO: 905 - DNA, 30 bp, Artificial Sequence; identical to SEQ ID NO: 169
  Synthetic

SEQ ID NO: 906 - DNA, 30 bp, Artificial Sequence; identical to SEQ ID NO: 169
  Synthetic

SEQ ID NO: 907 - DNA, 24 bp, Artificial Sequence
  Synthetic
ccttccttatcctggatcttggca

SEQ ID NO: 908 - DNA, 24 bp, Artificial Sequence
  Synthetic
acgatagaaaatgtaaaggtgatc

SEQ ID NO: 909 - DNA, 29 bp, Artificial Sequence
  Synthetic
cgcagtgagaatgaggtgatctcggcggt

SEQ ID NO: 910 - DNA, 14 bp, Artificial Sequence
  Synthetic
  misc_feature (3)..(3): The residue at this position is linked to a Z21 quenching group.
ctcttctcagtgcg

SEQ ID NO: 911 - DNA, 25 bp, Artificial Sequence
  Synthetic
gtttcttttgtgtctccgcactgcc

SEQ ID NO: 912 - DNA, 26 bp, Artificial Sequence
  Synthetic
ccagcagtaaatgctccagttgtaga

SEQ ID NO: 913 - DNA, 19 bp, Artificial Sequence
  Synthetic
tagaacttgaagtaggtgc

SEQ ID NO: 914 - DNA, 19 bp, Artificial Sequence
  Synthetic
caaagaaaacacaggaggc

SEQ ID NO: 915 - DNA, 27 bp, Artificial Sequence
  Synthetic
ccaggaagcaagtggaggcgtgacggu

SEQ ID NO: 916 - DNA, 13 bp, Artificial Sequence
  Synthetic
  misc_feature (3)..(3): The residue at this position is linked to a Z21 quenching group.
cactgcttcgtgg

SEQ ID NO: 917 - DNA, 26 bp, Artificial Sequence
  Synthetic
aacgaggcgcacctgtgttttctttg

SEQ ID NO: 918 - DNA, 26 bp, Artificial Sequence
  Synthetic
ccagcagtaaatgctccagttgtaga

SEQ ID NO: 919 - DNA, 19 bp, Artificial Sequence
  Synthetic
tagaacttgaagtaggtgc

SEQ ID NO: 920 - DNA, 19 bp, Artificial Sequence
  Synthetic
caaagaaaacacaggtgcg

SEQ ID NO: 921 - DNA, 27 bp, Artificial Sequence
  Synthetic
ccaggaagcaagtggtgcgcctcgttt

SEQ ID NO: 922 - DNA, 13 bp, Artificial Sequence
  Synthetic
  misc_feature (3)..(3): The residue at this position is linked to a Z21 quenching group.
cactgcttcgtgg

SEQ ID NO: 923 - DNA, 24 bp, Artificial Sequence
  Synthetic
ccgtcacgcctcctccagttgtag

SEQ ID NO: 924 - DNA, 30 bp, Artificial Sequence; identical to SEQ ID NO: 207
  Synthetic

SEQ ID NO: 925 - DNA, 20 bp, Artificial Sequence
  Synthetic
ctgtgttttctttgtagaac

SEQ ID NO: 926 - DNA, 17 bp, Artificial Sequence
  Synthetic
ctacaactggaggaggc

SEQ ID NO: 927 - DNA, 27 bp, Artificial Sequence
  Synthetic
ccaggaagcaagtggaggcgtgacggu

SEQ ID NO: 928 - DNA, 13 bp, Artificial Sequence
  Synthetic
  misc_feature (3)..(3): The residue at this position is linked to a Z21 quenching group.
cactgcttcgtgg

SEQ ID NO: 929 - DNA, 24 bp, Artificial Sequence
  Synthetic
aacgaggcgcacctccagttgtag

SEQ ID NO: 930 - DNA, 30 bp, Artificial Sequence; identical to SEQ ID NO: 207
  Synthetic

SEQ ID NO: 931 - DNA, 20 bp, Artificial Sequence
  Synthetic
ctgtgttttctttgtagaac

SEQ ID NO: 932 - DNA, 17 bp, Artificial Sequence
  Synthetic
ctacaactggaggtgcg

SEQ ID NO: 933 - DNA, 27 bp, Artificial Sequence
  Synthetic
ccaggaagcaagtggtgcgcctcgttt

SEQ ID NO: 934 - DNA, 13 bp, Artificial Sequence
  Synthetic
  misc_feature (3)..(3): The residue at this position is linked to a Z21 quenching group.
cactgcttcgtgg

SEQ ID NO: 935 - DNA, 28 bp, Artificial Sequence
  Synthetic
ccgtcacgcctcctgtgttttctttgta

SEQ ID NO: 936 - DNA, 32 bp, Artificial Sequence
  Synthetic
gtaaatccagcagtaaatgctccagttgtaga

SEQ ID NO: 937 - DNA, 23 bp, Artificial Sequence
  Synthetic
gaacttgaagtaggtgcactgtt

SEQ ID NO: 938 - DNA, 23 bp, Artificial Sequence
  Synthetic
tacaaagaaaacacaggaggcgt

SEQ ID NO: 939 - DNA, 27 bp, Artificial Sequence
  Synthetic
ccaggaagcaagtggaggcgtgacggu

SEQ ID NO: 940 - DNA, 13 bp, Artificial Sequence
  Synthetic
  misc_feature (3)..(3): The residue at this position is linked to a Z21 quenching group.
cactgcttcgtgg

SEQ ID NO: 941 - DNA, 28 bp, Artificial Sequence
  Synthetic
aacgaggcgcacctgtgttttctttgta

SEQ ID NO: 942 - DNA, 32 bp, Artificial Sequence; identical to SEQ ID NO: 936
  Synthetic

SEQ ID NO: 943 - DNA, 23 bp, Artificial Sequence
  Synthetic
gaacttgaagtaggtgcactgtt

SEQ ID NO: 944 - DNA, 21 bp, Artificial Sequence
  Synthetic
tacaaagaaaacacaggtgcg

SEQ ID NO: 945 - DNA, 27 bp, Artificial Sequence
  Synthetic
ccaggaagcaagtggtgcgcctcgttt

SEQ ID NO: 946 - DNA, 13 bp, Artificial Sequence
  Synthetic
  misc_feature (3)..(3): The residue at this position is linked to a Z21 quenching group.
cactgcttcgtgg

SEQ ID NO: 947 - DNA, 24 bp, Artificial Sequence
  Synthetic
ccgtcacgcctcctccagttgtaa

SEQ ID NO: 948 - DNA, 24 bp, Artificial Sequence
  Synthetic
ccgtcacgcctcctccagttgtat

SEQ ID NO: 949 - DNA, 24 bp, Artificial Sequence
  Synthetic
ccgtcacgcctcctccagttgtac

SEQ ID NO: 950 - DNA, 30 bp, Artificial Sequence; identical to SEQ ID NO: 207
  Synthetic

SEQ ID NO: 951 - DNA, 20 bp, Artificial Sequence
  Synthetic
ctgtgttttctttgtagaac

SEQ ID NO: 952 - DNA, 17 bp, Artificial Sequence
  Synthetic
ctacaactggaggaggc

SEQ ID NO: 953 - DNA, 27 bp, Artificial Sequence
  Synthetic
ccaggaagcaagtggaggcgtgacggu

SEQ ID NO: 954 - DNA, 13 bp, Artificial Sequence
  Synthetic
  misc_feature (3)..(3): The residue at this position is linked to a Z21 quenching group.
cactgcttcgtgg

SEQ ID NO: 955 - DNA, 24 bp, Artificial Sequence
  Synthetic
gccgtcacgcctcccttcttgatg

SEQ ID NO: 956 - DNA, 33 bp, Artificial Sequence
  Synthetic
ttctagacactgaagatgtttcagttctgtgga

SEQ ID NO: 957 - DNA, 20 bp, Artificial Sequence
  Synthetic
catgcccaagaagggaggcg

SEQ ID NO: 958 - DNA, 28 bp, Artificial Sequence
  Synthetic
cggaagaagcagttggaggcgtgacggc

SEQ ID NO: 959 - DNA, 14 bp, Artificial Sequence
  Synthetic
  misc_feature (4)..(4): The residue at this position is linked to a spacer bearing a Cy3 dye.
caacgcttcctccg

SEQ ID NO: 960 - DNA, 33 bp, Artificial Sequence
  Synthetic
ccgtcacgcctctaattccattcaaaatcatct

SEQ ID NO: 961 - DNA, 34 bp, Artificial Sequence
  Synthetic
catcctggtgagtttgggattcttgtaatttata

SEQ ID NO: 962 - DNA, 25 bp, Artificial Sequence
  Synthetic
gtaaatccagcagtaaatgctccag

SEQ ID NO: 963 - DNA, 27 bp, Artificial Sequence
  Synthetic
agatgattttgaatggaattagaggcg

SEQ ID NO: 964 - DNA, 28 bp, Artificial Sequence
  Synthetic
cggaagaagcagttggaggcgtgacggc

SEQ ID NO: 965 - DNA, 14 bp, Artificial Sequence
  Synthetic
  misc_feature (4)..(4): The residue at this position is linked to a spacer bearing a Cy3 dye.
caacgcttcctccg

SEQ ID NO: 966 - DNA, 29 bp, Artificial Sequence
  Synthetic
ccgccgagatcacctgtgttttctttgta

SEQ ID NO: 967 - DNA, 32 bp, Artificial Sequence; identical to SEQ ID NO: 936
  Synthetic

SEQ ID NO: 968 - DNA, 23 bp, Artificial Sequence
  Synthetic
gaacttgaagtaggtgcactgtt

SEQ ID NO: 969 - DNA, 23 bp, Artificial Sequence
  Synthetic
gaacttgaagtaggtgcactgtt

SEQ ID NO: 970 - DNA, 23 bp, Artificial Sequence
  Synthetic
gaacttgaagtaggtgcactgtt

SEQ ID NO: 971 - DNA, 23 bp, Artificial Sequence
  Synthetic
gaacttgaagtaggtgcactgtt

SEQ ID NO: 972 - DNA, 23 bp, Artificial Sequence
  Synthetic
tacaaagaaaacacaggtgatct

SEQ ID NO: 973 - DNA, 28 bp, Artificial Sequence
  Synthetic
cggaggaagcagttggtgatctcggcgg

SEQ ID NO: 974 - DNA, 14 bp, Artificial Sequence
  Synthetic
  misc_feature (4)..(4): The residue at this position is linked to a spacer bearing a Cy3 dye.
caacgcttcctccg

SEQ ID NO: 975 - DNA, 26 bp, Artificial Sequence
  Synthetic
aacgaggcgcacccttcttgggcatg

SEQ ID NO: 976 - DNA, 33 bp, Artificial Sequence; identical to SEQ ID NO: 956
  Synthetic

SEQ ID NO: 977 - DNA, 19 bp, Artificial Sequence
  Synthetic
catgcccaagaagggtgcg

SEQ ID NO: 978 - DNA, 29 bp, Artificial Sequence
  Synthetic
cggaagaagcagttggtgcgcctcgttaa

SEQ ID NO: 979 - DNA, 14 bp, Artificial Sequence
  Synthetic
  misc_feature (4)..(4): The residue at this position is linked to a spacer bearing a Cy3 dye.
caacgcttcctccg

SEQ ID NO: 980 - DNA, 33 bp, Artificial Sequence
  Synthetic
aacgaggcgcactaattccattcaaaatcatct

SEQ ID NO: 981 - DNA, 34 bp, Artificial Sequence; identical to SEQ ID NO: 961
  Synthetic

SEQ ID NO: 982 - DNA, 25 bp, Artificial Sequence
  Synthetic
gtaaatccagcagtaaatgctccag

SEQ ID NO: 983 - DNA, 26 bp, Artificial Sequence
  Synthetic
agatgattttgaatggaattagtggt

SEQ ID NO: 984 - DNA, 29 bp, Artificial Sequence
  Synthetic
cggaagaagcagttggtgcgcctcgttaa

SEQ ID NO: 985 - DNA, 14 bp, Artificial Sequence
  Synthetic
  misc_feature (4)..(4): The residue at this position is linked to a spacer bearing a Cy3 dye.
caacgcttcctccg

SEQ ID NO: 986 - DNA, 30 bp, Artificial Sequence
  Synthetic
cctgtctcgctgccagttgtgttcttggag

SEQ ID NO: 987 - DNA, 22 bp, Artificial Sequence
  Synthetic
ccctgcagaaggtttccttcta

SEQ ID NO: 988 - DNA, 22 bp, Artificial Sequence
  Synthetic
ccctgcagatggtttccttcta

SEQ ID NO: 989 - DNA, 22 bp, Artificial Sequence
  Synthetic
ctccaagaacacaactggcagc

SEQ ID NO: 990 - DNA, 24 bp, Artificial Sequence
  Synthetic
ctccaagaacacaactggcagcga

SEQ ID NO: 991 - DNA, 26 bp, Artificial Sequence
  Synthetic
ctccaagaacacaactggcagcgaga

SEQ ID NO: 992 - DNA, 28 bp, Artificial Sequence
  Synthetic
cggaggaagcagttggcagcgagacagg

SEQ ID NO: 993 - DNA, 14 bp, Artificial Sequence
  Synthetic
  misc_feature (4)..(4): The residue at this position is linked to a spacer bearing a Cy3 dye.
caacgcttcctccg

SEQ ID NO: 994 - DNA, 27 bp, Artificial Sequence
  Synthetic
aacgaggcgcaccttggaggcagcaaa

SEQ ID NO: 995 - DNA, 26 bp, Artificial Sequence
  Synthetic
aacgaggcgcaccttggaggcagcaa

SEQ ID NO: 996 - DNA, 24 bp, Artificial Sequence
  Synthetic
aaggtttccttctcagttgtgtta

SEQ ID NO: 997 - DNA, 21 bp, Artificial Sequence
  Synthetic
ctttgctgcctccaaggtgcg

SEQ ID NO: 998 - DNA, 29 bp, Artificial Sequence
  Synthetic
cggaggaagcagttggtgcgcctcgttaa

SEQ ID NO: 999 - DNA, 14 bp, Artificial Sequence
  Synthetic
  misc_feature (4)..(4): The residue at this position is linked to a spacer bearing a Cy3 dye.
caacgcttcctccg

SEQ ID NO: 1000 - DNA, 29 bp, Artificial Sequence
  Synthetic
cagtcacgtctctggaggcagcaaagatg

SEQ ID NO: 1001 - DNA, 26 bp, Artificial Sequence
  Synthetic
aaggtttccttctcagttgtgttcta

SEQ ID NO: 1002 - DNA, 23 bp, Artificial Sequence
  Synthetic
catctttgctgcctccagagacg

SEQ ID NO: 1003 - DNA, 29 bp, Artificial Sequence
  Synthetic
gctactgagatgaaggagacgtgactgta

SEQ ID NO: 1004 - DNA, 14 bp, Artificial Sequence
  Synthetic
  misc_feature (4)..(4): The residue at this position is linked to a spacer bearing a Cy3 dye.
cttctctcagtagc

SEQ ID NO: 1005 - DNA, 28 bp, Artificial Sequence
  Synthetic
aacgaggcgcaccttggaggcagcaaag

SEQ ID NO: 1006 - DNA, 24 bp, Artificial Sequence
  Synthetic
aaggtttccttctcagttgtgtta

SEQ ID NO: 1007 - DNA, 21 bp, Artificial Sequence
  Synthetic
ctttgctgcctccaaggtgcg

SEQ ID NO: 1008 - DNA, 29 bp, Artificial Sequence
  Synthetic
cggaggaagcagttggtgcgcctcgttaa

SEQ ID NO: 1009 - DNA, 14 bp, Artificial Sequence
  Synthetic
  misc_feature (4)..(4): The residue at this position is linked to a spacer bearing a Cy3 dye.
caacgcttcctccg

SEQ ID NO: 1010 - DNA, 32 bp, Artificial Sequence
  Synthetic
cgccgagatcacccctttagttttacaacagt

SEQ ID NO: 1011 - DNA, 29 bp, Artificial Sequence
  Synthetic
gaattggcactcaaatgtgttgtcagaga

SEQ ID NO: 1012 - DNA, 28 bp, Artificial Sequence
  Synthetic
actgttgtaaaactaaagggggtgatct

SEQ ID NO: 1013 - DNA, 27 bp, Artificial Sequence
  Synthetic
cggaggaagcggttggtgatctcggcg

SEQ ID NO: 1014 - DNA, 14 bp, Artificial Sequence
  Synthetic
  misc_feature (4)..(4): The residue at this position is linked to a spacer bearing a Cy3 dye.
caacgcttcctccg

SEQ ID NO: 1015 - DNA, 35 bp, Artificial Sequence
  Synthetic
tgccgccgagatcacccctttagttttacaacagt

SEQ ID NO: 1016 - DNA, 29 bp, Artificial Sequence
  Synthetic
gaattggcactcaaatgtgttgtcagaga

SEQ ID NO: 1017 - DNA, 24 bp, Artificial Sequence
  Synthetic
actgttgtaaaactaaagggggtg

SEQ ID NO: 1018 - DNA, 26 bp, Artificial Sequence
  Synthetic
actgttgtaaaactaaagggggtgat

SEQ ID NO: 1019 - DNA, 28 bp, Artificial Sequence
  Synthetic
actgttgtaaaactaaagggggtgatct

SEQ ID NO: 1020 - DNA, 30 bp, Artificial Sequence
  Synthetic
actgttgtaaaactaaagggggtgatctcg

SEQ ID NO: 1021 - DNA, 30 bp, Artificial Sequence
  Synthetic
cggaggaagcggttggtgatctcggcggca

SEQ ID NO: 1022 - DNA, 14 bp, Artificial Sequence
  Synthetic
  misc_feature (4)..(4): The residue at this position is linked to a spacer bearing a Cy3 dye.
caacgcttcctccg

SEQ ID NO: 1023 - DNA, 34 bp, Artificial Sequence
  Synthetic
gccgccgagatcacccctttagttttacaacagt

SEQ ID NO: 1024 - DNA, 33 bp, Artificial Sequence
  Synthetic
ccgccgagatcacccctttagttttacaacagt

SEQ ID NO: 1025 - DNA, 29 bp, Artificial Sequence
  Synthetic
gaattggcactcaaatgtgttgtcagaga

SEQ ID NO: 1026 - DNA, 26 bp, Artificial Sequence
  Synthetic
actgttgtaaaactaaagggggtgat

SEQ ID NO: 1027 - DNA, 30 bp, Artificial Sequence; identical to SEQ ID NO: 1021
  Synthetic

SEQ ID NO: 1028 - DNA, 14 bp, Artificial Sequence
  Synthetic
  misc_feature (4)..(4): The residue at this position is linked to a spacer bearing a Cy3 dye.
caacgcttcctccg

SEQ ID NO: 1029 - DNA, 32 bp, Artificial Sequence
  Synthetic
aacgaggcgcacccctttagttttacaacagt

SEQ ID NO: 1030 - DNA, 29 bp, Artificial Sequence
  Synthetic
gaattggcactcaaatgtgttgtcagaga

SEQ ID NO: 1031 - DNA, 29 bp, Artificial Sequence
  Synthetic
agtaactgttgtaaaactaaaggggtgcg

SEQ ID NO: 1032 - DNA, 29 bp, Artificial Sequence
  Synthetic
cggaggaagcagttggtgcgcctcgttaa

SEQ ID NO: 1033 - DNA, 14 bp, Artificial Sequence
  Synthetic
  misc_feature (4)..(4): The residue at this position is linked to a spacer bearing a Cy3 dye.
caacgcttcctccg

SEQ ID NO: 1034 - DNA, 32 bp, Artificial Sequence; identical to SEQ ID NO: 1029
  Synthetic

SEQ ID NO: 1035 - DNA, 29 bp, Artificial Sequence
  Synthetic
gaattggcactcaaatgtgttgtcagaga

SEQ ID NO: 1036 - DNA, 29 bp, Artificial Sequence
  Synthetic
agtaactgttgtaaaactaaaggggtgcg

SEQ ID NO: 1037 - DNA, 29 bp, Artificial Sequence
  Synthetic
cggaggaagcagttggtgcgcctcgttaa

SEQ ID NO: 1038 - DNA, 14 bp, Artificial Sequence
  Synthetic
  misc_feature (4)..(4): The residue at this position is linked to a spacer bearing a Cy3 dye.
caacgcttcctccg

SEQ ID NO: 1039 - DNA, 29 bp, Artificial Sequence
  Synthetic
ccgtcacgcctcccctttagttttacaac

SEQ ID NO: 1040 - DNA, 29 bp, Artificial Sequence
  Synthetic
gaattggcactcaaatgtgttgtcagaga

SEQ ID NO: 1041 - DNA, 32 bp, Artificial Sequence
  Synthetic
agttactctgatattgctgatgaaattctcag

SEQ ID NO: 1042 - DNA, 23 bp, Artificial Sequence
  Synthetic
gttgtaaaactaaaggggaggcg

SEQ ID NO: 1043 - DNA, 28 bp, Artificial Sequence
  Synthetic
cggaagaagcagttggaggcgtgacggt

SEQ ID NO: 1044 - DNA, 14 bp, Artificial Sequence
  Synthetic
  misc_feature (4)..(4): The residue at this position is linked to a spacer bearing a Cy3 dye.
caacgcttcctccg

SEQ ID NO: 1045 - DNA, 29 bp, Artificial Sequence
  Synthetic
cgccgagatcacccctttagttttacaac

SEQ ID NO: 1046 - DNA, 29 bp, Artificial Sequence
  Synthetic
gaattggcactcaaatgtgttgtcagaga

SEQ ID NO: 1047 - DNA, 32 bp, Artificial Sequence; identical to SEQ ID NO: 1041
  Synthetic

SEQ ID NO: 1048 - DNA, 23 bp, Artificial Sequence
  Synthetic
gttgtaaaactaaaggggtgatc

SEQ ID NO: 1049 - DNA, 28 bp, Artificial Sequence
  Synthetic
cggaagaagcagttggtgatctcggcgg

SEQ ID NO: 1050 - DNA, 14 bp, Artificial Sequence
  Synthetic
  misc_feature (4)..(4): The residue at this position is linked to a spacer bearing a Cy3 dye.
caacgcttcctccg

SEQ ID NO: 1051 - DNA, 28 bp, Artificial Sequence
  Synthetic
ccgtcacgcctcccctttagttttacaa

SEQ ID NO: 1052 - DNA, 29 bp, Artificial Sequence
  Synthetic
gaattggcactcaaatgtgttgtcagaga

SEQ ID NO: 1053 - DNA, 32 bp, Artificial Sequence
  Synthetic
cagttactctgatattgctgatgaaattctca

SEQ ID NO: 1054 - DNA, 23 bp, Artificial Sequence
  Synthetic
gttgtaaaactaaaggggaggcg

SEQ ID NO: 1055 - DNA, 28 bp, Artificial Sequence
  Synthetic
cggaagaagcagttggaggcgtgacggt

SEQ ID NO: 1056 - DNA, 14 bp, Artificial Sequence
  Synthetic
  misc_feature (4)..(4): The residue at this position is linked to a spacer bearing a Cy3 dye.
caacgcttcctccg

SEQ ID NO: 1057 - DNA, 28 bp, Artificial Sequence
  Synthetic
ccgtcacgcctcccctttagttttacaa

SEQ ID NO: 1058 - DNA, 29 bp, Artificial Sequence
  Synthetic
gaattggcactcaaatgtgttgtcagaga

SEQ ID NO: 1059 - DNA, 32 bp, Artificial Sequence; identical to SEQ ID NO: 1053
  Synthetic

SEQ ID NO: 1060 - DNA, 23 bp, Artificial Sequence
  Synthetic
gttgtaaaactaaaggggaggcg

SEQ ID NO: 1061 - DNA, 27 bp, Artificial Sequence
  Synthetic
ccaggaagcagttggaggcgtgacggt

SEQ ID NO: 1062 - DNA, 13 bp, Artificial Sequence
  Synthetic
  misc_feature (4)..(4): The residue at this position is linked to a spacer bearing a Cy3 dye.
caacgcttcgtgg

SEQ ID NO: 1063 - DNA, 26 bp, Artificial Sequence
  Synthetic
ccgtcacgcctcccgttagctaagat

SEQ ID NO: 1064 - DNA, 24 bp, Artificial Sequence
  Synthetic
cgaggttttccaaggagttgttta

SEQ ID NO: 1065 - DNA, 22 bp, Artificial Sequence
  Synthetic
ccctggatcagatttagagagc

SEQ ID NO: 1066 - DNA, 20 bp, Artificial Sequence
  Synthetic
atcttagctaacgggaggcg

SEQ ID NO: 1067 - DNA, 28 bp, Artificial Sequence
  Synthetic
cggaagaagcagttggaggcgtgacggt

SEQ ID NO: 1068 - DNA, 14 bp, Artificial Sequence
  Synthetic
  misc_feature (4)..(4): The residue at this position is linked to a spacer bearing a Cy3 dye.
caacgcttcctccg

SEQ ID NO: 1069 - DNA, 25 bp, Artificial Sequence
  Synthetic
ccgtcacgcctcagttgtttccgtt

SEQ ID NO: 1070 - DNA, 27 bp, Artificial Sequence
  Synthetic
agaggtacaaacgaggttttccaaggc

SEQ ID NO: 1071 - DNA, 29 bp, Artificial Sequence
  Synthetic
agctaagatccctggatcagatttagaga

SEQ ID NO: 1072 - DNA, 19 bp, Artificial Sequence
  Synthetic
aacggaaacaactgaggcg

SEQ ID NO: 1073 - DNA, 27 bp, Artificial Sequence
  Synthetic
ccaggaagcaagtggaggcgtgacggu

SEQ ID NO: 1074 - DNA, 13 bp, Artificial Sequence
  Synthetic
  misc_feature (3)..(3): The residue at this position is linked to a Z21 quenching group.
cactgcttcgtgg

SEQ ID NO: 1075 - DNA, 22 bp, Artificial Sequence
  Synthetic
ccgtcacgcctcccgttagcta

SEQ ID NO: 1076 - DNA, 25 bp, Artificial Sequence
  Synthetic
caaacgaggttttccaaggagttga

SEQ ID NO: 1077 - DNA, 28 bp, Artificial Sequence
  Synthetic
agatccctggatcagatttagagagctc

SEQ ID NO: 1078 - DNA, 19 bp, Artificial Sequence
  Synthetic
tagctaacggaaagaggcg

SEQ ID NO: 1079 - DNA, 27 bp, Artificial Sequence
  Synthetic
ccaggaagcaagtggaggcgtgacggu

SEQ ID NO: 1080 - DNA, 13 bp, Artificial Sequence
  Synthetic
  misc_feature (3)..(3): The residue at this position is linked to a Z21 quenching group.
cactgcttcgtgg

SEQ ID NO: 1081 - DNA, 19 bp, Artificial Sequence
  Synthetic
ccgtcacgcctcccgttag

SEQ ID NO: 1082 - DNA, 29 bp, Artificial Sequence
  Synthetic
agaggtacaaacgaggttttccaaggaga

SEQ ID NO: 1083 - DNA, 28 bp, Artificial Sequence
  Synthetic
ctaagatccctggatcagatttagagag

SEQ ID NO: 1084 - DNA, 19 bp, Artificial Sequence
  Synthetic
ctaacggaaacaagaggcg

SEQ ID NO: 1085 - DNA, 27 bp, Artificial Sequence
  Synthetic
ccaggaagcaagtggaggcgtgacggu

SEQ ID NO: 1086 - DNA, 13 bp, Artificial Sequence
  Synthetic
  misc_feature (3)..(3): The residue at this position is linked to a Z21 quenching group.
cactgcttcgtgg

SEQ ID NO: 1087 - DNA, 37 bp, Artificial Sequence
  Synthetic
aacgaggcgcaccttaccaatgcctaagaaaagagtt

SEQ ID NO: 1088 - DNA, 36 bp, Artificial Sequence
  Synthetic
tgcattatttttctgtcactctcctctttccaatta

SEQ ID NO: 1089 - DNA, 30 bp, Artificial Sequence
  Synthetic
aactcttttcttaggcattttgaaggtgcg

SEQ ID NO: 1090 - DNA, 29 bp, Artificial Sequence
  Synthetic
cggaggaagcagttggtgcgcctcgttaa

SEQ ID NO: 1091 - DNA, 14 bp, Artificial Sequence
  Synthetic
  misc_feature (4)..(4): The residue at this position is linked to a spacer bearing a Cy3 dye.
caacgcttcctccg

SEQ ID NO: 1092 - DNA, 37 bp, Artificial Sequence
  Synthetic
cagtcacgtctctcttcaaaatgcctaagaaaagagt

SEQ ID NO: 1093 - DNA, 37 bp, Artificial Sequence
  Synthetic
tctgcattatttttctgtcactctcctctttccaata

SEQ ID NO: 1094 - DNA, 31 bp, Artificial Sequence
  Synthetic
actcttttcttaggcattttgaagagagacg

SEQ ID NO: 1095 - DNA, 29 bp, Artificial Sequence
  Synthetic
gctactgagatgaaggagacgtgactgta

SEQ ID NO: 1096 - DNA, 14 bp, Artificial Sequence
  Synthetic
  misc_feature (4)..(4): The residue at this position is linked to a spacer bearing a Cy3 dye.
cttctctcagtagc

SEQ ID NO: 1097 - DNA, 27 bp, Artificial Sequence
  Synthetic
aacgaggcgcacccttttgccagttcc

SEQ ID NO: 1098 - DNA, 27 bp, Artificial Sequence
  Synthetic
gctctgcaggattttcatgtcaccata

SEQ ID NO: 1099 - DNA, 22 bp, Artificial Sequence
  Synthetic
gaggaactggcaaaagggtgcg

SEQ ID NO: 1100 - DNA, 29 bp, Artificial Sequence
  Synthetic
gctactgagatgaaggagacgtgactgta

SEQ ID NO: 1101 - DNA, 14 bp, Artificial Sequence
  Synthetic
  misc_feature (4)..(4): The residue at this position is linked to a spacer bearing a Cy3 dye.
cttctctcagtagc

SEQ ID NO: 1102 - DNA, 24 bp, Artificial Sequence
  Synthetic
aacgaggcgcacccttttgccagt

SEQ ID NO: 1103 - DNA, 27 bp, Artificial Sequence
  Synthetic
gctctgcaggattttcatgtcaccata

SEQ ID NO: 1104 - DNA, 26 bp, Artificial Sequence
  Synthetic
tcctccagatatccaagaagagactc

SEQ ID NO: 1105 - DNA, 17 bp, Artificial Sequence
  Synthetic
actggcaaaaggcgggc

SEQ ID NO: 1106 - DNA, 30 bp, Artificial Sequence
  Synthetic
cggaggaaagcagttggtgcgcctcguuaa

SEQ ID NO: 1107 - DNA, 30 bp, Artificial Sequence
  Synthetic
cggaagaaagcagttggtgcgcctcguuaa

SEQ ID NO: 1108 - DNA, 14 bp, Artificial Sequence
  Synthetic
  misc_feature (4)..(4): The residue at this position is linked to a spacer bearing a Cy3 dye.
caacgcttcctccg

SEQ ID NO: 1109 - DNA, 23 bp, Artificial Sequence
  Synthetic
gccgcacgccgccttttgccagt

SEQ ID NO: 1110 - DNA, 27 bp, Artificial Sequence
  Synthetic
gctctgcaggattttcatgtcaccata

SEQ ID NO: 1111 - DNA, 26 bp, Artificial Sequence
  Synthetic
tcctccagatatccaagaagagactc

SEQ ID NO: 1112 - DNA, 17 bp, Artificial Sequence
  Synthetic
actggcaaaaggcgggc

SEQ ID NO: 1113 - DNA, 27 bp, Artificial Sequence
  Synthetic
cggaggaagcagttgcggcgtgcggca

SEQ ID NO: 1114 - DNA, 14 bp, Artificial Sequence
  Synthetic
  misc_feature (4)..(4): The residue at this position is linked to a spacer bearing a Cy3 dye.
caacgcttcctccg

SEQ ID NO: 1115 - DNA, 26 bp, Artificial Sequence
  Synthetic
aacgaggcgcacccttttgccagttc

SEQ ID NO: 1116 - DNA, 27 bp, Artificial Sequence
  Synthetic
gctctgcaggattttcatgtcaccata

SEQ ID NO: 1117 - DNA, 24 bp, Artificial Sequence
  Synthetic
ctccagatatccaagaagagactc

SEQ ID NO: 1118 - DNA, 19 bp, Artificial Sequence
  Synthetic
gaactggcaaaagggtgcg

SEQ ID NO: 1119 - DNA, 29 bp, Artificial Sequence
  Synthetic
cggaggaagcagttggtgcgcctcgttaa

SEQ ID NO: 1120 - DNA, 14 bp, Artificial Sequence
  Synthetic
  misc_feature (4)..(4): The residue at this position is linked to a spacer bearing a Cy3 dye.
caacgcttcctccg

SEQ ID NO: 1121 - DNA, 29 bp, Artificial Sequence
  Synthetic
ccgtcacgcctccttggcaaaactgcacc

SEQ ID NO: 1122 - DNA, 30 bp, Artificial Sequence
  Synthetic
ccgtcacgcctccttggcaaaactgcacca

SEQ ID NO: 1123 - DNA, 35 bp, Artificial Sequence
  Synthetic
ctttatgcactgacatctaagttctttagcactca

SEQ ID NO: 1124 - DNA, 24 bp, Artificial Sequence
  Synthetic
tggtgcagttttgccaaggaggcg

SEQ ID NO: 1125 - DNA, 26 bp, Artificial Sequence
  Synthetic
tggtgcagttttgccaaggaggcgtg

SEQ ID NO: 1126 - DNA, 28 bp, Artificial Sequence
  Synthetic
cggaagaagcagttggaggcgtgacggc

SEQ ID NO: 1127 - DNA, 14 bp, Artificial Sequence
  Synthetic
  misc_feature (4)..(4): The residue at this position is linked to a spacer bearing a Cy3 dye.
caacgcttcctccg

SEQ ID NO: 1128 - DNA, 31 bp, Artificial Sequence
  Synthetic
ccgtcacgcctccatcttcactgattcttgg

SEQ ID NO: 1129 - DNA, 32 bp, Artificial Sequence
  Synthetic
ccgtcacgcctccatcttcactgattcttgga

SEQ ID NO: 1130 - DNA, 35 bp, Artificial Sequence
  Synthetic
agtgttgaagtagatttgcttgaagtttcactgga

SEQ ID NO: 1131 - DNA, 22 bp, Artificial Sequence
  Synthetic
gataccacagagaatgaatttt

SEQ ID NO: 1132 - DNA, 26 bp, Artificial Sequence
  Synthetic
tccaagaatcagtgaagatggaggcg

SEQ ID NO: 1133 - DNA, 28 bp, Artificial Sequence
  Synthetic
tccaagaatcagtgaagatggaggcgtg

SEQ ID NO: 1134 - DNA, 21 bp, Artificial Sequence
  Synthetic
gaatcagtgaagatggaggcg

SEQ ID NO: 1135 - DNA, 28 bp, Artificial Sequence
  Synthetic
cggaagaagcagttggaggcgtgacggc

SEQ ID NO: 1136 - DNA, 14 bp, Artificial Sequence
  Synthetic
  misc_feature (4)..(4): The residue at this position is linked to a spacer bearing a Cy3 dye.
caacgcttcctccg

SEQ ID NO: 1137 - DNA, 27 bp, Artificial Sequence
  Synthetic
ccgtcacgcccttggctcaattttgct

SEQ ID NO: 1138 - DNA, 42 bp, Artificial Sequence
  Synthetic
ccattcaattcctgaaattaaagttcggatattctcttggca

SEQ ID NO: 1139 - DNA, 32 bp, Artificial Sequence
  Synthetic
cctgaaattaaagttcggatattctcttggca

SEQ ID NO: 1140 - DNA, 32 bp, Artificial Sequence; identical to SEQ ID NO: 1139
  Synthetic

SEQ ID NO: 1141 - DNA, 24 bp, Artificial Sequence
  Synthetic
agcaaaattgagccaagggaggcg

SEQ ID NO: 1142 - DNA, 26 bp, Artificial Sequence
  Synthetic
agcaaaattgagccaagggaggcgtg

SEQ ID NO: 1143 - DNA, 28 bp, Artificial Sequence
  Synthetic
cggaagaagcagttggaggcgtgacggc

SEQ ID NO: 1144 - DNA, 14 bp, Artificial Sequence
  Synthetic
  misc_feature (4)..(4): The residue at this position is linked to a spacer bearing a Cy3 dye.
caacgcttcctccg

SEQ ID NO: 1145 - DNA, 30 bp, Artificial Sequence
  Synthetic
ccgtcacgcctccatcttcactgattcttg

SEQ ID NO: 1146 - DNA, 47 bp, Artificial Sequence
  Synthetic
ttctagcaaacccattcaattcctgaaattaaagttcggatattcta

SEQ ID NO: 1147 - DNA, 37 bp, Artificial Sequence
  Synthetic
cccattcaattcctgaaattaaagttcggatattcta

SEQ ID NO: 1148 - DNA, 37 bp, Artificial Sequence; identical to SEQ ID NO: 1147
  Synthetic

SEQ ID NO: 1149 - DNA, 19 bp, Artificial Sequence
  Synthetic
ccaagggccaaggaggcgt

SEQ ID NO: 1150 - DNA, 28 bp, Artificial Sequence
  Synthetic
cggaagaagcagttggaggcgtgacggc

SEQ ID NO: 1151 - DNA, 14 bp, Artificial Sequence
  Synthetic
  misc_feature (4)..(4): The residue at this position is linked to a spacer bearing a Cy3 dye.
caacgcttcctccg

SEQ ID NO: 1152 - DNA, 27 bp, Artificial Sequence
  Synthetic
ccgtcacgcctccatcttcactgattc

SEQ ID NO: 1153 - DNA, 35 bp, Artificial Sequence; identical to SEQ ID NO: 1130
  Synthetic

SEQ ID NO: 1154 - DNA, 23 bp, Artificial Sequence
  Synthetic
ttggataccacagagaatgaatt

SEQ ID NO: 1155 - DNA, 28 bp, Artificial Sequence
  Synthetic
cggaagaagcagttggaggcgtgacggt

SEQ ID NO: 1156 - DNA, 14 bp, Artificial Sequence
  Synthetic
  misc_feature (4)..(4): The residue at this position is linked to a spacer bearing a Cy3 dye.
caacgcttcctccg

SEQ ID NO: 1157 - DNA, 26 bp, Artificial Sequence
  Synthetic
ccgtcacgcctccatcttcactgatt

SEQ ID NO: 1158 - DNA, 35 bp, Artificial Sequence; identical to SEQ ID NO: 1130
  Synthetic

SEQ ID NO: 1159 - DNA, 24 bp, Artificial Sequence
  Synthetic
cttggataccacagagaatgaatt

SEQ ID NO: 1160 - DNA, 28 bp, Artificial Sequence
  Synthetic
cggaagaagcagttggaggcgtgacggt

SEQ ID NO: 1161 - DNA, 14 bp, Artificial Sequence
  Synthetic
  misc_feature (4)..(4): The residue at this position is linked to a spacer bearing a Cy3 dye.
caacgcttcctccg

SEQ ID NO: 1162 - DNA, 30 bp, Artificial Sequence; identical to SEQ ID NO: 1145
  Synthetic

SEQ ID NO: 1163 - DNA, 35 bp, Artificial Sequence; identical to SEQ ID NO: 1130
  Synthetic

SEQ ID NO: 1164 - DNA, 27 bp, Artificial Sequence
  Synthetic
ataccacagagaatgaatttttttatg

SEQ ID NO: 1165 - DNA, 28 bp, Artificial Sequence
  Synthetic
tccaagaatcagtgaagatggaggcgtg

SEQ ID NO: 1166 - DNA, 28 bp, Artificial Sequence
  Synthetic
cggaagaagcagttggaggcgtgacggt

SEQ ID NO: 1167 - DNA, 14 bp, Artificial Sequence
  Synthetic
  misc_feature (4)..(4): The residue at this position is linked to a spacer bearing a Cy3 dye.
caacgcttcctccg

SEQ ID NO: 1168 - DNA, 28 bp, Artificial Sequence
  Synthetic
cggaagaagcagttggtgatctcggcgg

SEQ ID NO: 1169 - DNA, 14 bp, Artificial Sequence
  Synthetic
  misc_feature (4)..(4): The residue at this position is linked to a spacer bearing a Cy3 dye.
caacgcttcctccg

SEQ ID NO: 1170 - DNA, 28 bp, Artificial Sequence
  Synthetic
cggaagaagcagttggaggcgtgacggt

SEQ ID NO: 1171 - DNA, 14 bp, Artificial Sequence
  Synthetic
  misc_feature (4)..(4): The residue at this position is linked to a spacer bearing a Cy3 dye.
caacgcttcctccg

SEQ ID NO: 1172 - DNA, 27 bp, Artificial Sequence
  Synthetic
ccaggaagcaagtggaggcgtgacggu

SEQ ID NO: 1173 - DNA, 13 bp, Artificial Sequence
  Synthetic
  misc_feature (3)..(3): The residue at this position is linked to a Z21 quenching group.
cactgcttcgtgg

SEQ ID NO: 1174 - DNA, 28 bp, Artificial Sequence
  Synthetic
cggaggaagcagttggtgatctcggcgg

SEQ ID NO: 1175 - DNA, 14 bp, Artificial Sequence
  Synthetic
  misc_feature (4)..(4): The residue at this position is linked to a spacer bearing a Cy3 dye.
caacgcttcctccg

SEQ ID NO: 1176 - DNA, 28 bp, Artificial Sequence
  Synthetic
cggaagaagcagttggaggcgtgacggc

SEQ ID NO: 1177 - DNA, 14 bp, Artificial Sequence
  Synthetic
  misc_feature (4)..(4): The residue at this position is linked to a spacer bearing a Cy3 dye.
caacgcttcctccg

SEQ ID NO: 1178 - DNA, 27 bp, Artificial Sequence
  Synthetic
ccaggaagcaagtggtgcgcctcgttt

SEQ ID NO: 1179 - DNA, 13 bp, Artificial Sequence
  Synthetic
  misc_feature (3)..(3): The residue at this position is linked to a Z21 quenching group.
cactgcttcgtgg

SEQ ID NO: 1180 - DNA, 29 bp, Artificial Sequence
  Synthetic
cggaggaagcagttggtgcgcctcgttaa

SEQ ID NO: 1181 - DNA, 14 bp, Artificial Sequence
  Synthetic
  misc_feature (4)..(4): The residue at this position is linked to a spacer bearing a Cy3 dye.
caacgcttcctccg

SEQ ID NO: 1182 - DNA, 30 bp, Artificial Sequence; identical to SEQ ID NO: 1021
  Synthetic

SEQ ID NO: 1183 - DNA, 14 bp, Artificial Sequence
  Synthetic
  misc_feature (4)..(4): The residue at this position is linked to a spacer bearing a Cy3 dye.
caacgcttcctccg

SEQ ID NO: 1184 - DNA, 29 bp, Artificial Sequence
  Synthetic
gctactgagatgaaggagacgtgactgta

SEQ ID NO: 1185 - DNA, 14 bp, Artificial Sequence
  Synthetic
  misc_feature (4)..(4): The residue at this position is linked to a spacer bearing a Cy3 dye.
cttctctcagtagc

SEQ ID NO: 1186 - DNA, 27 bp, Artificial Sequence
  Synthetic
ccaggaagcagttggaggcgtgacggt

SEQ ID NO: 1187 - DNA, 13 bp, Artificial Sequence
  Synthetic
  misc_feature (4)..(4): The residue at this position is linked to a spacer bearing a Cy3 dye.
caacgcttcgtgg

SEQ ID NO: 1188 - DNA, 24 bp, Artificial Sequence
  Synthetic
aggagccactccattggatgaagc

SEQ ID NO: 1189 - DNA, 30 bp, Artificial Sequence
  Synthetic
atgtacagaatccccggttatttatgcaga

SEQ ID NO: 1190 - DNA, 24 bp, Artificial Sequence
  Synthetic
gtggcgtatcacagacaatgagag

SEQ ID NO: 1191 - DNA, 32 bp, Artificial Sequence
  Synthetic
cctcctttatattcccaagtataacactctaa

SEQ ID NO: 1192 - DNA, 27 bp, Artificial Sequence
  Synthetic
aacgaggcgcaccacagacaatgagag

SEQ ID NO: 1193 - DNA, 20 bp, Artificial Sequence
  Synthetic
ctctcattgtctgtggtgcg

SEQ ID NO: 1194 - DNA, 32 bp, Artificial Sequence; identical to SEQ ID NO: 1191
  Synthetic

SEQ ID NO: 1195 - DNA, 27 bp, Artificial Sequence
  Synthetic
agctcaatgcatgtacagaatccccgg

SEQ ID NO: 1196 - DNA, 27 bp, Artificial Sequence
  Synthetic
agctcaatgcatgtacagaatccccgg

SEQ ID NO: 1197 - DNA, 29 bp, Artificial Sequence
  Synthetic
aacgaggcgcaccacagacaatgagagag

SEQ ID NO: 1198 - DNA, 22 bp, Artificial Sequence
  Synthetic
ctctctcattgtctgtggtgcg

SEQ ID NO: 1199 - DNA, 32 bp, Artificial Sequence; identical to SEQ ID NO: 1191
  Synthetic

SEQ ID NO: 1200 - DNA, 27 bp, Artificial Sequence
  Synthetic
ctcaatgcatgtacagaatccccggtt

SEQ ID NO: 1201 - DNA, 31 bp, Artificial Sequence
  Synthetic
aacgaggcgcaccacagacaatgagagagct

SEQ ID NO: 1202 - DNA, 24 bp, Artificial Sequence
  Synthetic
agctctctcattgtctgtggtgcg

SEQ ID NO: 1203 - DNA, 32 bp, Artificial Sequence; identical to SEQ ID NO: 1191
  Synthetic

SEQ ID NO: 1204 - DNA, 14 bp, Artificial Sequence
  Synthetic
  misc_feature (4)..(4): The residue at this position is linked to a spacer bearing a Cy3 dye.
caacgcttcctccg

SEQ ID NO: 1205 - DNA, 30 bp, Artificial Sequence
  Synthetic
aacgaggcgcaccacagacaatgagagagc

SEQ ID NO: 1206 - DNA, 23 bp, Artificial Sequence
  Synthetic
gctctctcattgtctgtggtgcg

SEQ ID NO: 1207 - DNA, 32 bp, Artificial Sequence; identical to SEQ ID NO: 1191
  Synthetic

SEQ ID NO: 1208 - DNA, 14 bp, Artificial Sequence
  Synthetic
  misc_feature (4)..(4): The residue at this position is linked to a spacer bearing a Cy3 dye.
caacgcttcctccg

SEQ ID NO: 1209 - DNA, 28 bp, Artificial Sequence
  Synthetic
aacgaggcgcaccacagacaatgagaga

SEQ ID NO: 1210 - DNA, 28 bp, Artificial Sequence
  Synthetic
aacgaggcgcaccacagacaatgagaga

SEQ ID NO: 1211 - DNA, 22 bp, Artificial Sequence
  Synthetic
tctctcattgtctgtggtgcgc

SEQ ID NO: 1212 - DNA, 28 bp, Artificial Sequence
  Synthetic
gctcaatgcatgtacagaatccccggtt

SEQ ID NO: 1213 - DNA, 32 bp, Artificial Sequence; identical to SEQ ID NO: 1191
  Synthetic

SEQ ID NO: 1214 - DNA, 26 bp, Artificial Sequence
  Synthetic
aacgaggcgcaccacagacaatgaga

SEQ ID NO: 1215 - DNA, 20 bp, Artificial Sequence
  Synthetic
tctcattgtctgtggtgcgc

SEQ ID NO: 1216 - DNA, 32 bp, Artificial Sequence; identical to SEQ ID NO: 1191
  Synthetic

SEQ ID NO: 1217 - DNA, 27 bp, Artificial Sequence
  Synthetic
gagctcaatgcatgtacagaatccccg

SEQ ID NO: 1218 - DNA, 27 bp, Artificial Sequence
  Synthetic
aacgaggcgcacctcttatcagagctc

SEQ ID NO: 1219 - DNA, 27 bp, Artificial Sequence
  Synthetic
aacgaggcgcacctcttatcagagctc

SEQ ID NO: 1220 - DNA, 32 bp, Artificial Sequence
  Synthetic
ttgtggaggaaattattgagaaatgttgatta

SEQ ID NO: 1221 - DNA, 20 bp, Artificial Sequence
  Synthetic
gagctctgataagaggtgcg

SEQ ID NO: 1222 - DNA, 20 bp, Artificial Sequence
  Synthetic
ccgtcacgcctcgccccaca

SEQ ID NO: 1223 - DNA, 14 bp, Artificial Sequence
  Synthetic
tgtggggcgaggcg

SEQ ID NO: 1224 - DNA, 28 bp, Artificial Sequence
  Synthetic
cagcacaggctgttgaccatcataaaac

SEQ ID NO: 1225 - DNA, 25 bp, Artificial Sequence
  Synthetic
cuuuuccauacuuuuuaugacauuc

SEQ ID NO: 1226 - DNA, 25 bp, Artificial Sequence
  Synthetic
cttttccagactttttatgacattc

SEQ ID NO: 1227 - DNA, 21 bp, Artificial Sequence
  Synthetic
cttttccagactttttatgac

SEQ ID NO: 1228 - DNA, 20 bp, Artificial Sequence
  Synthetic
ccgtcacgcctcgccccaca

SEQ ID NO: 1229 - DNA, 20 bp, Artificial Sequence
  Synthetic
ccgtcacgcctcgccccaca

SEQ ID NO: 1230 - DNA, 28 bp, Artificial Sequence
  Synthetic
cagcacaggctgttgaccatcataaaac

SEQ ID NO: 1231 - DNA, 25 bp, Artificial Sequence
  Synthetic
cuuuuccauacuuuuuaugacauuc

SEQ ID NO: 1232 - DNA, 20 bp, Artificial Sequence
  Synthetic
ccgtcacgcctcgccccacc

SEQ ID NO: 1233 - DNA, 20 bp, Artificial Sequence
  Synthetic
ccgtcacgcctcgccccacg

SEQ ID NO: 1234 - DNA, 20 bp, Artificial Sequence
  Synthetic
ccgtcacgcctcgccccact

SEQ ID NO: 1235 - DNA, 14 bp, Artificial Sequence
  Synthetic
tgtggggcgaggcg

SEQ ID NO: 1236 - DNA, 28 bp, Artificial Sequence
  Synthetic
cagcacaggctgttgaccatcataaaac

SEQ ID NO: 1237 - DNA, 25 bp, Artificial Sequence
  Synthetic
cuuuuccauacuuuuuaugacauuc

SEQ ID NO: 1238 - DNA, 25 bp, Artificial Sequence
  Synthetic
ccgtcacgcctgatcataaaagccc

SEQ ID NO: 1239 - DNA, 19 bp, Artificial Sequence
  Synthetic
gggcttttatgatcaggcg

SEQ ID NO: 1240 - DNA, 19 bp, Artificial Sequence
  Synthetic
cagcacaggctgttgaccc

SEQ ID NO: 1241 - DNA, 23 bp, Artificial Sequence
  Synthetic
cacacttttccatactttttatg

SEQ ID NO: 1242 - DNA, 25 bp, Artificial Sequence
  Synthetic
aacgaggcgcacccattggatgaag

SEQ ID NO: 1243 - DNA, 19 bp, Artificial Sequence
  Synthetic
cttcatccaatgggtgcgc

SEQ ID NO: 1244 - DNA, 29 bp, Artificial Sequence
  Synthetic
gtacagaatccccggttatttatgcagta

SEQ ID NO: 1245 - DNA, 18 bp, Artificial Sequence
  Synthetic
cccatcttcatttcagag

SEQ ID NO: 1246 - DNA, 25 bp, Artificial Sequence
  Synthetic
gtggcgtatcgtgtctaatttcaag

SEQ ID NO: 1247 - DNA, 31 bp, Artificial Sequence
  Synthetic
aatgggtttttctggttgaagaagtccttga

SEQ ID NO: 1248 - DNA, 28 bp, Artificial Sequence
  Synthetic
aacgaggcgcaccgtgtctaatttcaag

SEQ ID NO: 1249 - DNA, 30 bp, Artificial Sequence
  Synthetic
aacgaggcgcaccgtgtctaatttcaaggg

SEQ ID NO: 1250 - DNA, 21 bp, Artificial Sequence
  Synthetic
cttgaaattagacacggtgcg

SEQ ID NO: 1251 - DNA, 31 bp, Artificial Sequence; identical to SEQ ID NO: 1247
  Synthetic

SEQ ID NO: 1252 - DNA, 28 bp, Artificial Sequence
  Synthetic
aacgaggcgcaccgtgtctaatttcaag

SEQ ID NO: 1253 - DNA, 21 bp, Artificial Sequence
  Synthetic
cttgaaattagacacggtgcg

SEQ ID NO: 1254 - DNA, 31 bp, Artificial Sequence; identical to SEQ ID NO: 1247
  Synthetic

SEQ ID NO: 1255 - DNA, 24 bp, Artificial Sequence
  Synthetic
gggatctgtgtttctttacaaggt

SEQ ID NO: 1256 - DNA, 28 bp, Artificial Sequence
  Synthetic
aacgaggcgcaccgtgtctaatttcaag

SEQ ID NO: 1257 - DNA, 22 bp, Artificial Sequence
  Synthetic
cttgaaattagacacggttctc

SEQ ID NO: 1258 - DNA, 27 bp, Artificial Sequence
  Synthetic
ggtttttctggttgaagaagtccttga

SEQ ID NO: 1259 - DNA, 15 bp, Artificial Sequence
  Synthetic
gggatctctgtttct

SEQ ID NO: 1260 - DNA, 30 bp, Artificial Sequence; identical to SEQ ID NO: 1249
  Synthetic

SEQ ID NO: 1261 - DNA, 23 bp, Artificial Sequence
  Synthetic
cccttgaaattagacacggtgcg

SEQ ID NO: 1262 - DNA, 31 bp, Artificial Sequence; identical to SEQ ID NO: 1247
  Synthetic

SEQ ID NO: 1263 - DNA, 14 bp, Artificial Sequence
  Synthetic
  misc_feature (4)..(4): The residue at this position is linked to a spacer bearing a Cy3 dye.
caacgcttcctccg

SEQ ID NO: 1264 - DNA, 29 bp, Artificial Sequence
  Synthetic
aacgaggcgcaccgtgtctaatttcaagg

SEQ ID NO: 1265 - DNA, 29 bp, Artificial Sequence
  Synthetic
aacgaggcgcaccgtgtctaatttcaagg

SEQ ID NO: 1266 - DNA, 23 bp, Artificial Sequence
  Synthetic
ccttgaaattagacacggtgcgc

SEQ ID NO: 1267 - DNA, 23 bp, Artificial Sequence
  Synthetic
ccttgaaattagacacggtgcgc

SEQ ID NO: 1268 - DNA, 31 bp, Artificial Sequence; identical to SEQ ID NO: 1247
  Synthetic

SEQ ID NO: 1269 - DNA, 32 bp, Artificial Sequence
  Synthetic
ggatctgtgtttctttacaaggtttgaaggag

SEQ ID NO: 1270 - DNA, 27 bp, Artificial Sequence
  Synthetic
aacgaggcgcaccgtgtctaatttcaa

SEQ ID NO: 1271 - DNA, 21 bp, Artificial Sequence
  Synthetic
ttgaaattagacacggtgcgc

SEQ ID NO: 1272 - DNA, 31 bp, Artificial Sequence; identical to SEQ ID NO: 1247
  Synthetic

SEQ ID NO: 1273 - DNA, 24 bp, Artificial Sequence
  Synthetic
ggggatctgtgtttctttacaagg

SEQ ID NO: 1274 - DNA, 26 bp, Artificial Sequence
  Synthetic
aacgaggcgcaccgtgtctaatttca

SEQ ID NO: 1275 - DNA, 20 bp, Artificial Sequence
  Synthetic
tgaaattagacacggtgcgc

SEQ ID NO: 1276 - DNA, 27 bp, Artificial Sequence
  Synthetic
ggtttttctggttgaagaagtccttga

SEQ ID NO: 1277 - DNA, 17 bp, Artificial Sequence
  Synthetic
aggggatctgtgtttct

SEQ ID NO: 1278 - DNA, 24 bp, Artificial Sequence
  Synthetic
tggcgtatctgaccctttgggaat

SEQ ID NO: 1279 - DNA, 29 bp, Artificial Sequence
  Synthetic
gaagagcataagttggaatcaccaccata

SEQ ID NO: 1280 - DNA, 24 bp, Artificial Sequence
  Synthetic
atacggttggtcctctcaagtcta

SEQ ID NO: 1281 - DNA, 30 bp, Artificial Sequence
  Synthetic
ccccattgatttcaacatctttcttgcaac

SEQ ID NO: 1282 - DNA, 26 bp, Artificial Sequence
  Synthetic
aacgaggcgcacgcgtgtctaatttc

SEQ ID NO: 1283 - DNA, 20 bp, Artificial Sequence
  Synthetic
gaaattagacacgcgtgcgc

SEQ ID NO: 1284 - DNA, 26 bp, Artificial Sequence
  Synthetic
ggtttttctggttgaagaagtccttc

SEQ ID NO: 1285 - DNA, 17 bp, Artificial Sequence
  Synthetic
ccggggatctgtgtttc

SEQ ID NO: 1286 - DNA, 26 bp, Artificial Sequence
  Synthetic
ccgtcacgcctcgcgtgtctaatttc

SEQ ID NO: 1287 - DNA, 20 bp, Artificial Sequence
  Synthetic
gaaattagacacgcgaggcg

SEQ ID NO: 1288 - DNA, 26 bp, Artificial Sequence
  Synthetic
ggtttttctggttgaagaagtccttc

SEQ ID NO: 1289 - DNA, 17 bp, Artificial Sequence
  Synthetic
ccggggatctgtgtttc

SEQ ID NO: 1290 - DNA, 24 bp, Artificial Sequence
  Synthetic
aacgaggcgcagttcatacgttcc

SEQ ID NO: 1291 - DNA, 18 bp, Artificial Sequence
  Synthetic
ggaacgtatgaactgcgc

SEQ ID NO: 1292 - DNA, 20 bp, Artificial Sequence
  Synthetic
ccagcacagggagttgacca

SEQ ID NO: 1293 - DNA, 19 bp, Artificial Sequence
  Synthetic
ccacatttttccatacttt

SEQ ID NO: 1294 - DNA, 24 bp, Artificial Sequence
  Synthetic
ccgtcacgcctgttcatacgttcc

SEQ ID NO: 1295 - DNA, 18 bp, Artificial Sequence
  Synthetic
ggaacgtatgaacaggcg

SEQ ID NO: 1296 - DNA, 20 bp, Artificial Sequence
  Synthetic
ccagcacagggagttgacca

SEQ ID NO: 1297 - DNA, 19 bp, Artificial Sequence
  Synthetic
ccacatttttccatacttt

SEQ ID NO: 1298 - DNA, 24 bp, Artificial Sequence
  Synthetic
aacgaggcgcacagttgaccttca

SEQ ID NO: 1299 - DNA, 24 bp, Artificial Sequence
  Synthetic
aacgaggcgcacagttgaccttca

SEQ ID NO: 1300 - DNA, 24 bp, Artificial Sequence
  Synthetic
aacgaggcgcacagttgaccttca

SEQ ID NO: 1301 - DNA, 18 bp, Artificial Sequence
  Synthetic
tgaaggtcaactgtgcgc

SEQ ID NO: 1302 - DNA, 19 bp, Artificial Sequence
  Synthetic
gtgatggccagcacagggc

SEQ ID NO: 1303 - DNA, 19 bp, Artificial Sequence
  Synthetic
tacgttccccacatttttc

SEQ ID NO: 1304 - DNA, 19 bp, Artificial Sequence
  Synthetic
tacgttccccacatttttc

SEQ ID NO: 1305 - DNA, 24 bp, Artificial Sequence
  Synthetic
ccgtcacgcctcagttgaccttca

SEQ ID NO: 1306 - DNA, 18 bp, Artificial Sequence
  Synthetic
tgaaggtcaactgaggcg

SEQ ID NO: 1307 - DNA, 19 bp, Artificial Sequence
  Synthetic
gtgatggccagcacagggc

SEQ ID NO: 1308 - DNA, 19 bp, Artificial Sequence
  Synthetic
tacgttccccacatttttc

SEQ ID NO: 1309 - DNA, 23 bp, Artificial Sequence
  Synthetic
aacgaggcgcactcctctcaagt

SEQ ID NO: 1310 - DNA, 17 bp, Artificial Sequence
  Synthetic
acttgagaggagtgcgc

SEQ ID NO: 1311 - DNA, 29 bp, Artificial Sequence
  Synthetic
ccattgatttcaacatctttcttgcaaga

SEQ ID NO: 1312 - DNA, 22 bp, Artificial Sequence
  Synthetic
ctaatagcaactgggaataatc

SEQ ID NO: 1313 - DNA, 23 bp, Artificial Sequence
  Synthetic
ccgtcacgcctctcctctcaagt

SEQ ID NO: 1314 - DNA, 17 bp, Artificial Sequence
  Synthetic
acttgagaggagaggcg

SEQ ID NO: 1315 - DNA, 29 bp, Artificial Sequence
  Synthetic
ccattgatttcaacatctttcttgcaaga

SEQ ID NO: 1316 - DNA, 22 bp, Artificial Sequence
  Synthetic
ctaatagcaactgggaataatc

SEQ ID NO: 1317 - DNA, 23 bp, Artificial Sequence
  Synthetic
aacgaggcgcacagttgaccttc

SEQ ID NO: 1318 - DNA, 18 bp, Artificial Sequence
  Synthetic
tgaaggtcaactgtgcgc

SEQ ID NO: 1319 - DNA, 19 bp, Artificial Sequence
  Synthetic
gtgatggccagcacagggc

SEQ ID NO: 1320 - DNA, 20 bp, Artificial Sequence
  Synthetic
atacgttccccacatttttc

SEQ ID NO: 1321 - DNA, 27 bp, Artificial Sequence
  Synthetic
tggcgtatctggattaaatcttaaaag

SEQ ID NO: 1322 - DNA, 31 bp, Artificial Sequence
  Synthetic
gacttttattgagagaacgaatggatctaaa

SEQ ID NO: 1323 - DNA, 30 bp, Artificial Sequence
  Synthetic
aacgaggcgcactggattaaatcttaaaag

SEQ ID NO: 1324 - DNA, 31 bp, Artificial Sequence; identical to SEQ ID NO: 1322
  Synthetic

SEQ ID NO: 1325 - DNA, 23 bp, Artificial Sequence
  Synthetic
cttttaagatttaatccagtgcg

SEQ ID NO: 1326 - DNA, 30 bp, Artificial Sequence; identical to SEQ ID NO: 1323
  Synthetic

SEQ ID NO: 1327 - DNA, 31 bp, Artificial Sequence; identical to SEQ ID NO: 1322
  Synthetic

SEQ ID NO: 1328 - DNA, 23 bp, Artificial Sequence
  Synthetic
cttttaagatttaatccagtgcg

SEQ ID NO: 1329 - DNA, 17 bp, Artificial Sequence
  Synthetic
cttcttggtgttttcca

SEQ ID NO: 1330 - DNA, 22 bp, Artificial Sequence
  Synthetic
aggagccactcatcccttgact

SEQ ID NO: 1331 - DNA, 29 bp, Artificial Sequence
  Synthetic
cttagggaaatcaggctccacttacggta

SEQ ID NO: 1332 - DNA, 26 bp, Artificial Sequence
  Synthetic
aacgaggcgcacctcatcccttgact

SEQ ID NO: 1333 - DNA, 26 bp, Artificial Sequence
  Synthetic
aacgaggcgcacctcatcccttgact

SEQ ID NO: 1334 - DNA, 19 bp, Artificial Sequence
  Synthetic
agtcaagggatgaggtgcg

SEQ ID NO: 1335 - DNA, 29 bp, Artificial Sequence
  Synthetic
cttagggaaatcaggctccacttacggta

SEQ ID NO: 1336 - DNA, 25 bp, Artificial Sequence
  Synthetic
aacgaggcgcacctcatcccttgac

SEQ ID NO: 1337 - DNA, 19 bp, Artificial Sequence
  Synthetic
gtcaagggatgaggtgcgc

SEQ ID NO: 1338 - DNA, 29 bp, Artificial Sequence
  Synthetic
cttagggaaatcaggctccacttacggta

SEQ ID NO: 1339 - DNA, 32 bp, Artificial Sequence
  Synthetic
tcagcctttagaacaatgggtttttctgttag

SEQ ID NO: 1340 - DNA, 28 bp, Artificial Sequence
  Synthetic
tcagcctttagaacaatgggtttttctg

SEQ ID NO: 1341 - DNA, 28 bp, Artificial Sequence
  Synthetic
ctcagcctttagaacaatgggtttttct

SEQ ID NO: 1342 - DNA, 28 bp, Artificial Sequence
  Synthetic
ctcagcctttagaacaatgggtttttct

SEQ ID NO: 1343 - DNA, 24 bp, Artificial Sequence
  Synthetic
aacgaggcgcacctcatcccttga

SEQ ID NO: 1344 - DNA, 25 bp, Artificial Sequence
  Synthetic
aacgaggcgcacctcatcccttgac

SEQ ID NO: 1345 - DNA, 18 bp, Artificial Sequence
  Synthetic
tcaagggatgaggtgcgc

SEQ ID NO: 1346 - DNA, 29 bp, Artificial Sequence
  Synthetic
cttagggaaatcaggctccacttacggta

SEQ ID NO: 1347 - DNA, 33 bp, Artificial Sequence
  Synthetic
ctcagcctttagaacaatgggtttttctgttag

SEQ ID NO: 1348 - DNA, 26 bp, Artificial Sequence
  Synthetic
atacggttggtaaagtaatttgaggt

SEQ ID NO: 1349 - DNA, 31 bp, Artificial Sequence
  Synthetic
gaagcccgtcttcatttcagggttctatttc

SEQ ID NO: 1350 - DNA, 29 bp, Artificial Sequence
  Synthetic
aacgaggcgcacgtaaagtaatttgaggt

SEQ ID NO: 1351 - DNA, 31 bp, Artificial Sequence; identical to SEQ ID NO: 1349
  Synthetic

SEQ ID NO: 1352 - DNA, 22 bp, Artificial Sequence
  Synthetic
acctcaaattactttacgtgcg

SEQ ID NO: 1353 - DNA, 29 bp, Artificial Sequence
  Synthetic
aacgaggcgcacgtaaagtaatttgaggt

SEQ ID NO: 1354 - DNA, 31 bp, Artificial Sequence; identical to SEQ ID NO: 1349
  Synthetic

SEQ ID NO: 1355 - DNA, 22 bp, Artificial Sequence
  Synthetic
acctcaaattactttacgtgcg

SEQ ID NO: 1356 - DNA, 15 bp, Artificial Sequence
  Synthetic
ctctggtgttctggg

SEQ ID NO: 1357 - DNA, 26 bp, Artificial Sequence
  Synthetic
ccgtcacgcctcgtcataaatacccc

SEQ ID NO: 1358 - DNA, 20 bp, Artificial Sequence
  Synthetic
ggggtctttatgacgaggcg

SEQ ID NO: 1359 - DNA, 21 bp, Artificial Sequence
  Synthetic
gccagcataggctgttgacac

SEQ ID NO: 1360 - DNA, 28 bp, Artificial Sequence
  Synthetic
agacttttctatactttttataacattc

SEQ ID NO: 1361 - DNA, 26 bp, Artificial Sequence
  Synthetic
aacgaggcgcacgtcataaatacccc

SEQ ID NO: 1362 - DNA, 26 bp, Artificial Sequence
  Synthetic
aacgaggcgcacgtcataaatacccc

SEQ ID NO: 1363 - DNA, 26 bp, Artificial Sequence
  Synthetic
aacgaggcgcacgtcataaatacccc

SEQ ID NO: 1364 - DNA, 20 bp, Artificial Sequence
  Synthetic
ggggtatttatgacgtgcgc

SEQ ID NO: 1365 - DNA, 21 bp, Artificial Sequence
  Synthetic
gccagcataggctgttgacac

SEQ ID NO: 1366 - DNA, 28 bp, Artificial Sequence
  Synthetic
agacttttctatactttttataacattc

SEQ ID NO: 1367 - DNA, 31 bp, Artificial Sequence
  Synthetic
ccgtcacgcctcgattaaatcttaaaagctt

SEQ ID NO: 1368 - DNA, 25 bp, Artificial Sequence
  Synthetic
aagcttttaagatttaatcgaggcg

SEQ ID NO: 1369 - DNA, 33 bp, Artificial Sequence
  Synthetic
gacttttattgagagaacgaatggatctaatgc

SEQ ID NO: 1370 - DNA, 19 bp, Artificial Sequence
  Synthetic
cttggtgttttccacaaag

SEQ ID NO: 1371 - DNA, 31 bp, Artificial Sequence
  Synthetic
aacgaggcgcacgattaaatcttaaaagctt

SEQ ID NO: 1372 - DNA, 25 bp, Artificial Sequence
  Synthetic
aagcttttaagatttaatcgtgcgc

SEQ ID NO: 1373 - DNA, 33 bp, Artificial Sequence; identical to SEQ ID NO: 1369
  Synthetic

SEQ ID NO: 1374 - DNA, 19 bp, Artificial Sequence
  Synthetic
cttggtgttttccacaaag

SEQ ID NO: 1375 - DNA, 22 bp, Artificial Sequence
  Synthetic
ccgtcacgcctgtcatcccttg

SEQ ID NO: 1376 - DNA, 16 bp, Artificial Sequence
  Synthetic
caagggatgcacggcg

SEQ ID NO: 1377 - DNA, 25 bp, Artificial Sequence
  Synthetic
ggaaatcaggctccacttacggtca

SEQ ID NO: 1378 - DNA, 20 bp, Artificial Sequence
  Synthetic
actcagcctttagaacaatg

SEQ ID NO: 1379 - DNA, 29 bp, Artificial Sequence
  Synthetic
ccgtcacgcctctaaagtaatttgaggtc

SEQ ID NO: 1380 - DNA, 23 bp, Artificial Sequence
  Synthetic
gacctcaaattactttagaggcg

SEQ ID NO: 1381 - DNA, 26 bp, Artificial Sequence
  Synthetic
cgtcttcatttcagggttctatttga

SEQ ID NO: 1382 - DNA, 14 bp, Artificial Sequence
  Synthetic
tctggtgttctggg

SEQ ID NO: 1383 - DNA, 29 bp, Artificial Sequence
  Synthetic
aacgaggcgcactaaagtaatttgaggtc

SEQ ID NO: 1384 - DNA, 23 bp, Artificial Sequence
  Synthetic
gacctcaaaggactttagtgcgc

SEQ ID NO: 1385 - DNA, 26 bp, Artificial Sequence
  Synthetic
cgtcttcatttcagggttctatttga

SEQ ID NO: 1386 - DNA, 14 bp, Artificial Sequence
  Synthetic
tctggtgttctggg

SEQ ID NO: 1387 - DNA, 23 bp, Artificial Sequence
  Synthetic
tggcgtatctaggctttgcttcc

SEQ ID NO: 1388 - DNA, 31 bp, Artificial Sequence; identical to SEQ ID NO: 696
  Synthetic

SEQ ID NO: 1389 - DNA, 26 bp, Artificial Sequence
  Synthetic
aacgaggcgcactaggctttgcttcc

SEQ ID NO: 1390 - DNA, 19 bp, Artificial Sequence
  Synthetic
ggaagcaaagcctagtgcg

SEQ ID NO: 1391 - DNA, 20 bp, Artificial Sequence
  Synthetic
ggaagcaaagcctagtgcgc

SEQ ID NO: 1392 - DNA, 31 bp, Artificial Sequence; identical to SEQ ID NO: 696
  Synthetic

SEQ ID NO: 1393 - DNA, 27 bp, Artificial Sequence
  Synthetic
aacgaggcgcactaggctttgcttccc

SEQ ID NO: 1394 - DNA, 21 bp, Artificial Sequence
  Synthetic
gggaagcaaagcctagtgcgc

SEQ ID NO: 1395 - DNA, 31 bp, Artificial Sequence; identical to SEQ ID NO: 696
  Synthetic

SEQ ID NO: 1396 - DNA, 25 bp, Artificial Sequence
  Synthetic
aacgaggcgcactaggctttgcttc

SEQ ID NO: 1397 - DNA, 19 bp, Artificial Sequence
  Synthetic
gaagcaaagcctagtgcgc

SEQ ID NO: 1398 - DNA, 22 bp, Artificial Sequence
  Synthetic
cccagaaccatcgaggaaaggc

SEQ ID NO: 1399 - DNA, 31 bp, Artificial Sequence; identical to SEQ ID NO: 696
  Synthetic

SEQ ID NO: 1400 - DNA, 24 bp, Artificial Sequence
  Synthetic
aacgaggcgcactaggctttgctt

SEQ ID NO: 1401 - DNA, 18 bp, Artificial Sequence
  Synthetic
aagcaaagcctagtgcgc

SEQ ID NO: 1402 - DNA, 31 bp, Artificial Sequence; identical to SEQ ID NO: 696
  Synthetic

SEQ ID NO: 1403 - DNA, 22 bp, Artificial Sequence
  Synthetic
ccccagaaccatcgaggaaagg

SEQ ID NO: 1404 - DNA, 22 bp, Artificial Sequence
  Synthetic
ccccagaaccatcgaggaaagg

SEQ ID NO: 1405 - DNA, 23 bp, Artificial Sequence
  Synthetic
aacgaggcgcactaggctttgct

SEQ ID NO: 1406 - DNA, 23 bp, Artificial Sequence
  Synthetic
aacgaggcgcactaggctttgct

SEQ ID NO: 1407 - DNA, 23 bp, Artificial Sequence
  Synthetic
aacgaggcgcactaggctttgct

SEQ ID NO: 1408 - DNA, 17 bp, Artificial Sequence
  Synthetic
agcaaagcctagtgcgc

SEQ ID NO: 1409 - DNA, 17 bp, Artificial Sequence
  Synthetic
agcaaagcctagtgcgc

SEQ ID NO: 1410 - DNA, 31 bp, Artificial Sequence; identical to SEQ ID NO: 696
  Synthetic

SEQ ID NO: 1411 - DNA, 23 bp, Artificial Sequence
  Synthetic
tccccagaaccatcgaggaaagg

SEQ ID NO: 1412 - DNA, 23 bp, Artificial Sequence
  Synthetic
tccccagaaccatcgaggaaagg

SEQ ID NO: 1413 - DNA, 22 bp, Artificial Sequence
  Synthetic
atacggttggtcttgacctgcc

SEQ ID NO: 1414 - DNA, 32 bp, Artificial Sequence
  Synthetic
aggagatatgttgaaagatttctatagaggac

SEQ ID NO: 1415 - DNA, 25 bp, Artificial Sequence
  Synthetic
aacgaggcgcacgtcttgacctgcc

SEQ ID NO: 1416 - DNA, 18 bp, Artificial Sequence
  Synthetic
ggcaggtcaagacgtgcg

SEQ ID NO: 1417 - DNA, 32 bp, Artificial Sequence; identical to SEQ ID NO: 1414
  Synthetic

SEQ ID NO: 1418 - DNA, 24 bp, Artificial Sequence
  Synthetic
aacgaggcgcacgtcttgacctgc

SEQ ID NO: 1419 - DNA, 18 bp, Artificial Sequence
  Synthetic
ggcaggtcaagacgtgcg

SEQ ID NO: 1420 - DNA, 32 bp, Artificial Sequence; identical to SEQ ID NO: 1414
  Synthetic

SEQ ID NO: 1421 - DNA, 25 bp, Artificial Sequence
  Synthetic
tggcgtatcttagatggagtaagga

SEQ ID NO: 1422 - DNA, 32 bp, Artificial Sequence
  Synthetic
attcctcataattcaaaagggacttagtaggt

SEQ ID NO: 1423 - DNA, 28 bp, Artificial Sequence
  Synthetic
aacgaggcgcacttagatggagtaagga

SEQ ID NO: 1424 - DNA, 21 bp, Artificial Sequence
  Synthetic
tccttactccatctaagtgcg

SEQ ID NO: 1425 - DNA, 26 bp, Artificial Sequence
  Synthetic
aacgaggcgcactggatacccttggg

SEQ ID NO: 1426 - DNA, 20 bp, Artificial Sequence
  Synthetic
cccaagggtatccagtgcgc

SEQ ID NO: 1427 - DNA, 30 bp, Artificial Sequence
  Synthetic
ggtggagaccataaatggagagtgtgacta

SEQ ID NO: 1428 - DNA, 30 bp, Artificial Sequence
  Synthetic
aacgaggcgcacaggtgtctggagtaaaag

SEQ ID NO: 1429 - DNA, 24 bp, Artificial Sequence
  Synthetic
cttttactccagacacctgtgcgc

SEQ ID NO: 1430 - DNA, 20 bp, Artificial Sequence
  Synthetic
gtccacgcacaagctgggac

SEQ ID NO: 1431 - DNA, 24 bp, Artificial Sequence
  Synthetic
aacgaggcgcacagaaggcccctt

SEQ ID NO: 1432 - DNA, 18 bp, Artificial Sequence
  Synthetic
aaggggccttctgtgcgc

SEQ ID NO: 1433 - DNA, 31 bp, Artificial Sequence; identical to SEQ ID NO: 700
  Synthetic

SEQ ID NO: 1434 - DNA, 23 bp, Artificial Sequence
  Synthetic
ggaagaacccagagacaccatcc

SEQ ID NO: 1435 - DNA, 24 bp, Artificial Sequence
  Synthetic
ccgtcacgcctcagaaggcccctt

SEQ ID NO: 1436 - DNA, 18 bp, Artificial Sequence
  Synthetic
aaggggccttctgaggcg

SEQ ID NO: 1437 - DNA, 31 bp, Artificial Sequence; identical to SEQ ID NO: 700
  Synthetic

SEQ ID NO: 1438 - DNA, 25 bp, Artificial Sequence
  Synthetic
aacgaggcgcacagaaggccccttg

SEQ ID NO: 1439 - DNA, 19 bp, Artificial Sequence
  Synthetic
caaggggccttctgtgcgc

SEQ ID NO: 1440 - DNA, 31 bp, Artificial Sequence; identical to SEQ ID NO: 700
  Synthetic

SEQ ID NO: 1441 - DNA, 26 bp, Artificial Sequence
  Synthetic
aacgaggcgcacagaaggccccttgg

SEQ ID NO: 1442 - DNA, 24 bp, Artificial Sequence
  Synthetic
aacgaggcgcacagaaggcccctt

SEQ ID NO: 1443 - DNA, 24 bp, Artificial Sequence
  Synthetic
aacgaggcgcacagaaggcccctt

SEQ ID NO: 1444 - DNA, 20 bp, Artificial Sequence
  Synthetic
ccaaggggccttctgtgcgc

SEQ ID NO: 1445 - DNA, 18 bp, Artificial Sequence
  Synthetic
aaggggccttctgtgcgc

SEQ ID NO: 1446 - DNA, 31 bp, Artificial Sequence; identical to SEQ ID NO: 700
  Synthetic

SEQ ID NO: 1447 - DNA, 26 bp, Artificial Sequence
  Synthetic
aacgaggcgcacttgacagagtccgc

SEQ ID NO: 1448 - DNA, 20 bp, Artificial Sequence
  Synthetic
gcggactctgtcaagtgcgc

SEQ ID NO: 1449 - DNA, 27 bp, Artificial Sequence
  Synthetic
gcttctcccatttgtctagcattataa

SEQ ID NO: 1450 - DNA, 25 bp, Artificial Sequence
  Synthetic
aacgaggcgcacttgacagagtccg

SEQ ID NO: 1451 - DNA, 19 bp, Artificial Sequence
  Synthetic
cggactctgtcaagtgcgc

SEQ ID NO: 1452 - DNA, 27 bp, Artificial Sequence
  Synthetic
gcttctcccatttgtctagcattataa

SEQ ID NO: 1453 - DNA, 29 bp, Artificial Sequence
  Synthetic
ccatgattttgacatagggtttgaggatg

SEQ ID NO: 1454 - DNA, 24 bp, Artificial Sequence
  Synthetic
aacgaggcgcacttgacagagtcc

SEQ ID NO: 1455 - DNA, 24 bp, Artificial Sequence
  Synthetic
aacgaggcgcacttgacagagtcc

SEQ ID NO: 1456 - DNA, 24 bp, Artificial Sequence
  Synthetic
aacgaggcgcacttgacagagtcc

SEQ ID NO: 1457 - DNA, 18 bp, Artificial Sequence
  Synthetic
ggactctgtcaagtgcgc

SEQ ID NO: 1458 - DNA, 18 bp, Artificial Sequence
  Synthetic
ggactctgtcaagtgcgc

SEQ ID NO: 1459 - DNA, 27 bp, Artificial Sequence
  Synthetic
gcttctcccatttgtctagcattataa

SEQ ID NO: 1460 - DNA, 30 bp, Artificial Sequence
  Synthetic
gccatgattttgacatagggtttgaggatg

SEQ ID NO: 1461 - DNA, 22 bp, Artificial Sequence
  Synthetic
cggagcctctgcggtcatcaag

SEQ ID NO: 1462 - DNA, 31 bp, Artificial Sequence
  Synthetic
tggataactgcatcagtgtatggcattttaa

SEQ ID NO: 1463 - DNA, 23 bp, Artificial Sequence
  Synthetic
gtggcgtatctgcggtcatcaag

SEQ ID NO: 1464 - DNA, 22 bp, Artificial Sequence
  Synthetic
gtggcgtatctgcggtcatcaa

SEQ ID NO: 1465 - DNA, 31 bp, Artificial Sequence; identical to SEQ ID NO: 1462
  Synthetic

SEQ ID NO: 1466 - DNA, 21 bp, Artificial Sequence
  Synthetic
tggcgtatctgcggtcatcaa

SEQ ID NO: 1467 - DNA, 31 bp, Artificial Sequence; identical to SEQ ID NO: 1462
  Synthetic

SEQ ID NO: 1468 - DNA, 25 bp, Artificial Sequence
  Synthetic
aacgaggcgcacctgcggtcatcaa

SEQ ID NO: 1469 - DNA, 20 bp, Artificial Sequence
  Synthetic
ttgatgaccgcaggtgcgcc

SEQ ID NO: 1470 - DNA, 20 bp, Artificial Sequence
  Synthetic
ttgatgaccgcaggtgcgcc

SEQ ID NO: 1471 - DNA, 20 bp, Artificial Sequence
  Synthetic
ttgatgaccgcaggtgcgcc

SEQ ID NO: 1472 - DNA, 31 bp, Artificial Sequence; identical to SEQ ID NO: 1462
  Synthetic

SEQ ID NO: 1473 - DNA, 25 bp, Artificial Sequence
  Synthetic
aacgaggcgcacctgcggtcatcaa

SEQ ID NO: 1474 - DNA, 20 bp, Artificial Sequence
  Synthetic
ttgatgaccgcaggtgcgcc

SEQ ID NO: 1475 - DNA, 31 bp, Artificial Sequence; identical to SEQ ID NO: 1462
  Synthetic

SEQ ID NO: 1476 - DNA, 25 bp, Artificial Sequence
  Synthetic
gggttggtagcctgtgtgagccgat

SEQ ID NO: 1477 - DNA, 25 bp, Artificial Sequence
  Synthetic
aacgaggcgcacctgcggtcatcaa

SEQ ID NO: 1478 - DNA, 18 bp, Artificial Sequence
  Synthetic
ttgatgaccgcaggtgcg

SEQ ID NO: 1479 - DNA, 31 bp, Artificial Sequence; identical to SEQ ID NO: 1462
  Synthetic

SEQ ID NO: 1480 - DNA, 29 bp, Artificial Sequence
  Synthetic
ggcaacgaggcacacctgcggtcatcaag

SEQ ID NO: 1481 - DNA, 20 bp, Artificial Sequence
  Synthetic
ttgatgaccgcaggtgcgcc

SEQ ID NO: 1482 - DNA, 31 bp, Artificial Sequence; identical to SEQ ID NO: 1462
  Synthetic

SEQ ID NO: 1483 - DNA, 26 bp, Artificial Sequence
  Synthetic
aacgaggggcacctgcggtcatcaag

SEQ ID NO: 1484 - DNA, 19 bp, Artificial Sequence
  Synthetic
cttgatgaccgcaggtgcc

SEQ ID NO: 1485 - DNA, 31 bp, Artificial Sequence; identical to SEQ ID NO: 1462
  Synthetic

SEQ ID NO: 1486 - DNA, 27 bp, Artificial Sequence
  Synthetic
aacgaggcgcacctgcggtcatcaagg

SEQ ID NO: 1487 - DNA, 20 bp, Artificial Sequence
  Synthetic
ccttgatgaccgcaggtgcg

SEQ ID NO: 1488 - DNA, 31 bp, Artificial Sequence; identical to SEQ ID NO: 1462
  Synthetic

SEQ ID NO: 1489 - DNA, 28 bp, Artificial Sequence
  Synthetic
atgacgtgacagacctgcggtcatcaag

SEQ ID NO: 1490 - DNA, 20 bp, Artificial Sequence
  Synthetic
cttgatgaccgcaggtctgt

SEQ ID NO: 1491 - DNA, 31 bp, Artificial Sequence; identical to SEQ ID NO: 1462
  Synthetic

SEQ ID NO: 1492 - DNA, 25 bp, Artificial Sequence
  Synthetic
aacgaggcgcacctgaggtcatcaa

SEQ ID NO: 1493 - DNA, 18 bp, Artificial Sequence
  Synthetic
ttgatgacctcaggtgcg

SEQ ID NO: 1494 - DNA, 31 bp, Artificial Sequence; identical to SEQ ID NO: 1462
  Synthetic

SEQ ID NO: 1495 - DNA, 26 bp, Artificial Sequence
  Synthetic
cagtcacgtctcctgcggtcatcaag

SEQ ID NO: 1496 - DNA, 20 bp, Artificial Sequence
  Synthetic
cttgatgaccgcaggagacg

SEQ ID NO: 1497 - DNA, 31 bp, Artificial Sequence; identical to SEQ ID NO: 1462
  Synthetic

SEQ ID NO: 1498 - DNA, 27 bp, Artificial Sequence
  Synthetic
cagtcacgtctcactgcggtcatcaag

SEQ ID NO: 1499 - DNA, 31 bp, Artificial Sequence; identical to SEQ ID NO: 676
  Synthetic

SEQ ID NO: 1500 - DNA, 21 bp, Artificial Sequence
  Synthetic
cttgatgaccgcagtgagacg

SEQ ID NO: 1501 - DNA, 26 bp, Artificial Sequence
  Synthetic
cagtcacgtctcactgcggtcatcaa

SEQ ID NO: 1502 - DNA, 20 bp, Artificial Sequence
  Synthetic
ttgatgaccgcagtgagacg

SEQ ID NO: 1503 - DNA, 31 bp, Artificial Sequence; identical to SEQ ID NO: 676
  Synthetic

SEQ ID NO: 1504 - DNA, 25 bp, Artificial Sequence
  Synthetic
gggttggtagcctgtgtgagccgat

SEQ ID NO: 1505 - DNA, 25 bp, Artificial Sequence
  Synthetic
cagtcacgtctcactgcggtcatca

SEQ ID NO: 1506 - DNA, 19 bp, Artificial Sequence
  Synthetic
tgatgaccgcagtgagacg

SEQ ID NO: 1507 - DNA, 31 bp, Artificial Sequence; identical to SEQ ID NO: 676
  Synthetic

SEQ ID NO: 1508 - DNA, 25 bp, Artificial Sequence
  Synthetic
agggttggtagcctgtgtgagccga

SEQ ID NO: 1509 - DNA, 27 bp, Artificial Sequence
  Synthetic
cagtcacgtctcactgcggtcatcaag

SEQ ID NO: 1510 - DNA, 21 bp, Artificial Sequence
  atg gtg tct ttg gtg act ctg tgt ggt aca
cttgatgaccgcagtgagacg

SEQ ID NO: 1511 - DNA, 31 bp, Artificial Sequence; identical to SEQ ID NO: 676
  atg gtg tct ttg gtg act ctg tgt ggt aca

SEQ ID NO: 1512 - DNA, 25 bp, Artificial Sequence
  atg gtg tct ttg gtg act ctg tgt ggt aca
ggttggtagcctgtgtgagccgatc

SEQ ID NO: 1513 - DNA, 23 bp, Artificial Sequence
  atg gtg tct ttg gtg act ctg tgt ggt aca
cagtcacgtctcactgcggtcat

SEQ ID NO: 1514 - DNA, 17 bp, Artificial Sequence
  atg gtg tct ttg gtg act ctg tgt ggt aca
atgaccgcagtgagacg

SEQ ID NO: 1515 - DNA, 31 bp, Artificial Sequence; identical to SEQ ID NO: 676
  atg gtg tct ttg gtg act ctg tgt ggt aca

SEQ ID NO: 1516 - DNA, 25 bp, Artificial Sequence
  atg gtg tct ttg gtg act ctg tgt ggt aca
caagggttggtagcctgtgtgagcc

SEQ ID NO: 1517 - DNA, 25 bp, Artificial Sequence
  atg gtg tct ttg gtg act ctg tgt ggt aca
ccgtcacgcctcactgcggtcatca

SEQ ID NO: 1518 - DNA, 19 bp, Artificial Sequence
  atg gtg tct ttg gtg act ctg tgt ggt aca
tgatgaccgcagtgaggcg

SEQ ID NO: 1519 - DNA, 31 bp, Artificial Sequence; identical to SEQ ID NO: 676
  atg gtg tct ttg gtg act ctg tgt ggt aca

SEQ ID NO: 1520 - DNA, 25 bp, Artificial Sequence
  atg gtg tct ttg gtg act ctg tgt ggt aca
agggttggtagcctgtgtgagccga

SEQ ID NO: 1521 - DNA, 24 bp, Artificial Sequence
  atg gtg tct ttg gtg act ctg tgt ggt aca
ccgtcacgcctcactgcggtcatc

SEQ ID NO: 1522 - DNA, 18 bp, Artificial Sequence
  atg gtg tct ttg gtg act ctg tgt ggt aca
gatgaccgcagtgaggcg

SEQ ID NO: 1523 - DNA, 31 bp, Artificial Sequence; identical to SEQ ID NO: 676
  atg gtg tct ttg gtg act ctg tgt ggt aca

SEQ ID NO: 1524 - DNA, 20 bp, Artificial Sequence
  atg gtg tct ttg gtg act ctg tgt ggt aca
aagggttggtagccggtgtg

SEQ ID NO: 1525 - DNA, 23 bp, Artificial Sequence
  atg gtg tct ttg gtg act ctg tgt ggt aca
ccgtcacgcctcactgcggtcat

SEQ ID NO: 1526 - DNA, 23 bp, Artificial Sequence
  atg gtg tct ttg gtg act ctg tgt ggt aca
ccgtcacgcctcactgcggtcat

SEQ ID NO: 1527 - DNA, 17 bp, Artificial Sequence
  atg gtg tct ttg gtg act ctg tgt ggt aca
atgaccgcagtgaggcg

SEQ ID NO: 1528 - DNA, 31 bp, Artificial Sequence; identical to SEQ ID NO: 676
  atg gtg tct ttg gtg act ctg tgt ggt aca

SEQ ID NO: 1529 - DNA, 25 bp, Artificial Sequence
  atg gtg tct ttg gtg act ctg tgt ggt aca
caagggttggtagcctgtgtgagcc

SEQ ID NO: 1530 - DNA, 30 bp, Artificial Sequence
  atg gtg tct ttg gtg act ctg tgt ggt aca
atggtgtctttggtgactctgtgtggtaca

SEQ ID NO: 1531 - DNA, 27 bp, Artificial Sequence
  Synthetic
aacgaggcgcactccaatagggacaag

SEQ ID NO: 1532 - DNA, 22 bp, Artificial Sequence
  Synthetic
cttgtccctattggagtgcgcc

SEQ ID NO: 1533 - DNA, 22 bp, Artificial Sequence
  Synthetic
gcggcgtacagccggtgtgagc

SEQ ID NO: 1534 - DNA, 29 bp, Artificial Sequence
  Synthetic
cattttactgcggtcatcaagggttggtc

SEQ ID NO: 1535 - DNA, 22 bp, Artificial Sequence
  Synthetic
tggcgtatgagccggtgtgagc

SEQ ID NO: 1536 - DNA, 29 bp, Artificial Sequence
  Synthetic
cattttactgcggtcatcaagggttggtc

SEQ ID NO: 1537 - DNA, 30 bp, Artificial Sequence
  Synthetic
ggatgactgcatcagtgtatggcattttgc

SEQ ID NO: 1538 - DNA, 27 bp, Artificial Sequence
  Synthetic
aacgaggcgcacgtacgatcatcaagg

SEQ ID NO: 1539 - DNA, 22 bp, Artificial Sequence
  Synthetic
ccttgatgatcgtacgtgcgcc

SEQ ID NO: 1540 - DNA, 30 bp, Artificial Sequence
  Synthetic
atggtgtctttggtgactctgtgtggtaac

SEQ ID NO: 1541 - DNA, 23 bp, Artificial Sequence
  Synthetic
tggcgtatgaccaattggggcaa

SEQ ID NO: 1542 - DNA, 29 bp, Artificial Sequence
  Synthetic
gatctgcaaatctctgaatctcgtggatg

SEQ ID NO: 1543 - DNA, 26 bp, Artificial Sequence
  Synthetic
tcttggagagcaggtaccctcggaac

SEQ ID NO: 1544 - DNA, 24 bp, Artificial Sequence
  Synthetic
tggcgtatgaccaattggggcaag

SEQ ID NO: 1545 - DNA, 30 bp, Artificial Sequence; identical to SEQ ID NO: 1540
  Synthetic

SEQ ID NO: 1546 - DNA, 29 bp, Artificial Sequence
  Synthetic
atctgcaaatctctgaatctcgtggatga

SEQ ID NO: 1547 - DNA, 26 bp, Artificial Sequence
  Synthetic
tcttggagagcaggtaccctcggaac

SEQ ID NO: 1548 - DNA, 27 bp, Artificial Sequence
  Synthetic
aacgaggcgcacaccaattggggcaag

SEQ ID NO: 1549 - DNA, 27 bp, Artificial Sequence
  Synthetic
aacgacgcgcacaccaattggggcaag

SEQ ID NO: 1550 - DNA, 22 bp, Artificial Sequence
  Synthetic
cttgccccaattggtgtgcgcc

SEQ ID NO: 1551 - DNA, 30 bp, Artificial Sequence; identical to SEQ ID NO: 1540
  Synthetic

SEQ ID NO: 1552 - DNA, 27 bp, Artificial Sequence
  Synthetic
aacgaggcgcacaccaattggggcaag

SEQ ID NO: 1553 - DNA, 22 bp, Artificial Sequence
  Synthetic
cttgccccaattggtgtgcgcc

SEQ ID NO: 1554 - DNA, 30 bp, Artificial Sequence; identical to SEQ ID NO: 1540
  Synthetic

SEQ ID NO: 1555 - DNA, 20 bp, Artificial Sequence
  Synthetic
cttgccccaattggtgtgcg

SEQ ID NO: 1556 - DNA, 27 bp, Artificial Sequence
  Synthetic
aacgaggcgcacaccaattggggcaag

SEQ ID NO: 1557 - DNA, 30 bp, Artificial Sequence; identical to SEQ ID NO: 1540
  Synthetic

SEQ ID NO: 1558 - DNA, 29 bp, Artificial Sequence
  Synthetic
atctgcaaatctctgaatctcgtggatga

SEQ ID NO: 1559 - DNA, 28 bp, Artificial Sequence
  Synthetic
ggcaacgaggcacaccaattggggcaag

SEQ ID NO: 1560 - DNA, 22 bp, Artificial Sequence
  Synthetic
cttgccccaattggtgtgcgcc

SEQ ID NO: 1561 - DNA, 30 bp, Artificial Sequence; identical to SEQ ID NO: 1540
  Synthetic

SEQ ID NO: 1562 - DNA, 30 bp, Artificial Sequence
  Synthetic
aacgaggcgcacaccaattggggcaagatc

SEQ ID NO: 1563 - DNA, 23 bp, Artificial Sequence
  Synthetic
gatcttgccccaattggtgtgcg

SEQ ID NO: 1564 - DNA, 30 bp, Artificial Sequence; identical to SEQ ID NO: 1540
  Synthetic

SEQ ID NO: 1565 - DNA, 27 bp, Artificial Sequence
  Synthetic
aacgaggcgcacaccaattcgggcaag

SEQ ID NO: 1566 - DNA, 20 bp, Artificial Sequence
  Synthetic
cttgcccgaattggtgtgcg

SEQ ID NO: 1567 - DNA, 30 bp, Artificial Sequence; identical to SEQ ID NO: 1540
  Synthetic

SEQ ID NO: 1568 - DNA, 29 bp, Artificial Sequence
  Synthetic
atctgcaaatctctgaatctcgtggatga

SEQ ID NO: 1569 - DNA, 25 bp, Artificial Sequence
  Synthetic
cagtcacgtctcatggtggcctgtg

SEQ ID NO: 1570 - DNA, 30 bp, Artificial Sequence
  Synthetic
gtatggcattttggtacgatcatcaagggc

SEQ ID NO: 1571 - DNA, 19 bp, Artificial Sequence
  Synthetic
cacaggccaccatgagacg

SEQ ID NO: 1572 - DNA, 27 bp, Artificial Sequence
  Synthetic
cagtcacgtctcagagccaatcacctg

SEQ ID NO: 1573 - DNA, 27 bp, Artificial Sequence
  Synthetic
cgatcatcaagggatggtggcctgtgc

SEQ ID NO: 1574 - DNA, 21 bp, Artificial Sequence
  Synthetic
caggtgattggctctgagacg

SEQ ID NO: 1575 - DNA, 28 bp, Artificial Sequence
  Synthetic
atcaatctccttttggactttctctgcg

SEQ ID NO: 1576 - DNA, 26 bp, Artificial Sequence
  Synthetic
cagtcacgtctcagagccaatcacct

SEQ ID NO: 1577 - DNA, 27 bp, Artificial Sequence
  Synthetic
cgatcatcaagggatggtggcctgtgc

SEQ ID NO: 1578 - DNA, 20 bp, Artificial Sequence
  Synthetic
aggtgattggctctgagacg

SEQ ID NO: 1579 - DNA, 28 bp, Artificial Sequence
  Synthetic
gatcaatctccttttggactttctctgc

SEQ ID NO: 1580 - DNA, 26 bp, Artificial Sequence
  Synthetic
cagtcacgtctcagagccaatcacct

SEQ ID NO: 1581 - DNA, 25 bp, Artificial Sequence
  Synthetic
cagtcacgtctcagagccaatcacc

SEQ ID NO: 1582 - DNA, 19 bp, Artificial Sequence
  Synthetic
ggtgattggctctgagacg

SEQ ID NO: 1583 - DNA, 27 bp, Artificial Sequence
  Synthetic
cgatcatcaagggatggtggcctgtgc

SEQ ID NO: 1584 - DNA, 28 bp, Artificial Sequence
  Synthetic
gatcaatctccttttggactttctctgc

SEQ ID NO: 1585 - DNA, 29 bp, Artificial Sequence
  Synthetic
tgatcaatctccttttggactttctctgc

SEQ ID NO: 1586 - DNA, 24 bp, Artificial Sequence
  Synthetic
cagtcacgtctcagagccaatcac

SEQ ID NO: 1587 - DNA, 18 bp, Artificial Sequence
  Synthetic
gtgattggctctgagacg

SEQ ID NO: 1588 - DNA, 31 bp, Artificial Sequence; identical to SEQ ID NO: 681
  Synthetic

SEQ ID NO: 1589 - DNA, 27 bp, Artificial Sequence
  Synthetic
cgatcatcaagggatggtggcctgtgc

SEQ ID NO: 1590 - DNA, 26 bp, Artificial Sequence
  Synthetic
cagtcacgtctcagaggcaatcacct

SEQ ID NO: 1591 - DNA, 20 bp, Artificial Sequence
  Synthetic
aggtgattgcctctgagacg

SEQ ID NO: 1592 - DNA, 27 bp, Artificial Sequence
  Synthetic
cgatcatcaagggatggtggcctgtgc

SEQ ID NO: 1593 - DNA, 28 bp, Artificial Sequence
  Synthetic
gatcaatctccttttggactttctctgc

SEQ ID NO: 1594 - DNA, 27 bp, Artificial Sequence
  Synthetic
cagtcacgtctcagaggcaatcacctg

SEQ ID NO: 1595 - DNA, 21 bp, Artificial Sequence
  Synthetic
caggtgattgcctctgagacg

SEQ ID NO: 1596 - DNA, 27 bp, Artificial Sequence
  Synthetic
cgatcatcaagggatggtggcctgtgc

SEQ ID NO: 1597 - DNA, 28 bp, Artificial Sequence
  Synthetic
atcaatctccttttggactttctctgcg

SEQ ID NO: 1598 - DNA, 26 bp, Artificial Sequence
  Synthetic
ccgtcacgcctcagagccaatcacct

SEQ ID NO: 1599 - DNA, 20 bp, Artificial Sequence
  Synthetic
aggtgattggctctgaggcg

SEQ ID NO: 1600 - DNA, 27 bp, Artificial Sequence
  Synthetic
cgatcatcaagggatggtggcctgtgc

SEQ ID NO: 1601 - DNA, 28 bp, Artificial Sequence
  Synthetic
gatcaatctccttttggactttctctgc

SEQ ID NO: 1602 - DNA, 25 bp, Artificial Sequence
  Synthetic
ccgtcacgcctcagagccaatcacc

SEQ ID NO: 1603 - DNA, 19 bp, Artificial Sequence
  Synthetic
ggtgattggctctgaggcg

SEQ ID NO: 1604 - DNA, 27 bp, Artificial Sequence
  Synthetic
cgatcatcaagggatggtggcctgtgc

SEQ ID NO: 1605 - DNA, 29 bp, Artificial Sequence
  Synthetic
tgatcaatctccttttggactttctctgc

SEQ ID NO: 1606 - DNA, 24 bp, Artificial Sequence
  Synthetic
ccgtcacgcctcagagccaatcac

SEQ ID NO: 1607 - DNA, 24 bp, Artificial Sequence
  Synthetic
ccgtcacgcctcagagccaatcac

SEQ ID NO: 1608 - DNA, 18 bp, Artificial Sequence
  Synthetic
gtgattggctctgaggcg

SEQ ID NO: 1609 - DNA, 27 bp, Artificial Sequence
  Synthetic
cgatcatcaagggatggtggcctgtgc

SEQ ID NO: 1610 - DNA, 31 bp, Artificial Sequence; identical to SEQ ID NO: 681
  Synthetic

SEQ ID NO: 1611 - DNA, 30 bp, Artificial Sequence
  Synthetic
cagtcacgtctcatggtcaaagtactgtgg

SEQ ID NO: 1612 - DNA, 29 bp, Artificial Sequence
  Synthetic
ggaagtgctcaggattgaaggtgtctggc

SEQ ID NO: 1613 - DNA, 24 bp, Artificial Sequence
  Synthetic
ccacagtactttgaccatgagacg

SEQ ID NO: 1614 - DNA, 30 bp, Artificial Sequence
  Synthetic
aacgaggcgcacatggtcaaagtactgtgg

SEQ ID NO: 1615 - DNA, 24 bp, Artificial Sequence
  Synthetic
ccacagtactttgaccatgtgcgc

SEQ ID NO: 1616 - DNA, 29 bp, Artificial Sequence
  Synthetic
ggaagtgctcaggattgaaggtgtctggc

SEQ ID NO: 1617 - DNA, 23 bp, Artificial Sequence
  Synthetic
catacggttgggcctgtgagagc

SEQ ID NO: 1618 - DNA, 29 bp, Artificial Sequence
  Synthetic
cattttggtacgatcatcaagggatggtc

SEQ ID NO: 1619 - DNA, 21 bp, Artificial Sequence
  Synthetic
aggagccacgggtcccaaatc

SEQ ID NO: 1620 - DNA, 21 bp, Artificial Sequence
  Synthetic
aggagccacgggtcccaaatc

SEQ ID NO: 1621 - DNA, 30 bp, Artificial Sequence; identical to SEQ ID NO: 688
  Synthetic

SEQ ID NO: 1622 - DNA, 22 bp, Artificial Sequence
  Synthetic
tcgcgtagtcgggtcccaaatc

SEQ ID NO: 1623 - DNA, 25 bp, Artificial Sequence
  Synthetic
catcttcgcggacgggtcccaaatc

SEQ ID NO: 1624 - DNA, 20 bp, Artificial Sequence
  Synthetic
gatttgggacccggtgcgcc

SEQ ID NO: 1625 - DNA, 25 bp, Artificial Sequence
  Synthetic
aacgaggcgcaccgggtcccaaatc

SEQ ID NO: 1626 - DNA, 25 bp, Artificial Sequence
  Synthetic
catcttcgcggacgggtcccaaatc

SEQ ID NO: 1627 - DNA, 21 bp, Artificial Sequence
  Synthetic
ggatttgggacccgtccgcga

SEQ ID NO: 1628 - DNA, 20 bp, Artificial Sequence
  Synthetic
ggatttgggacccgtccgcg

SEQ ID NO: 1629 - DNA, 19 bp, Artificial Sequence
  Synthetic
ggatttgggacccgtccgc

SEQ ID NO: 1630 - DNA, 18 bp, Artificial Sequence
  Synthetic
ggatttgggacccgtccg

SEQ ID NO: 1631 - DNA, 19 bp, Artificial Sequence
  Synthetic
gatttgggacccggtgcgc

SEQ ID NO: 1632 - DNA, 18 bp, Artificial Sequence
  Synthetic
gatttgggacccggtgcg

SEQ ID NO: 1633 - DNA, 17 bp, Artificial Sequence
  Synthetic
gatttgggacccggtgc

SEQ ID NO: 1634 - DNA, 21 bp, Artificial Sequence
  Synthetic
gatttgggacccggtgcgcct

SEQ ID NO: 1635 - DNA, 22 bp, Artificial Sequence
  Synthetic
gatttgggacccggtgcgcctc

SEQ ID NO: 1636 - DNA, 25 bp, Artificial Sequence
  Synthetic
aacgaggcgcaccgggtcccaaatc

SEQ ID NO: 1637 - DNA, 30 bp, Artificial Sequence; identical to SEQ ID NO: 688
  Synthetic

SEQ ID NO: 1638 - DNA, 25 bp, Artificial Sequence
  Synthetic
aacgaggcgcaccgggtcccaaatc

SEQ ID NO: 1639 - DNA, 18 bp, Artificial Sequence
  Synthetic
gatttgggacccggtgcg

SEQ ID NO: 1640 - DNA, 25 bp, Artificial Sequence
  Synthetic
aacgaggcgcaccgggtcccaaatc

SEQ ID NO: 1641 - DNA, 20 bp, Artificial Sequence
  Synthetic
ggatttgggacccggtgcgc

SEQ ID NO: 1642 - DNA, 24 bp, Artificial Sequence
  Synthetic
aacgaggcgcaccgggtcccaaat

SEQ ID NO: 1643 - DNA, 18 bp, Artificial Sequence
  Synthetic
atttgggacccggtgcgc

SEQ ID NO: 1644 - DNA, 21 bp, Artificial Sequence
  Synthetic
ccgtagaggagcaccaggacg

SEQ ID NO: 1645 - DNA, 23 bp, Artificial Sequence
  Synthetic
aacgaggcgcaccgggtcccaaa

SEQ ID NO: 1646 - DNA, 17 bp, Artificial Sequence
  Synthetic
tttgggacccggtgcgc

SEQ ID NO: 1647 - DNA, 20 bp, Artificial Sequence
  Synthetic
tccgtagaggagcaccagga

SEQ ID NO: 1648 - DNA, 23 bp, Artificial Sequence
  Synthetic
cagtcacgtctccgggtcccaaa

SEQ ID NO: 1649 - DNA, 17 bp, Artificial Sequence
  Synthetic
tttgggacccggagacg

SEQ ID NO: 1650 - DNA, 20 bp, Artificial Sequence
  Synthetic
tccgtagaggagcaccagga

SEQ ID NO: 1651 - DNA, 23 bp, Artificial Sequence
  Synthetic
ccgtcacgcctccgggtcccaaa

SEQ ID NO: 1652 - DNA, 17 bp, Artificial Sequence
  Synthetic
tttgggacccggaggcg

SEQ ID NO: 1653 - DNA, 20 bp, Artificial Sequence
  Synthetic
tccgtagaggagcaccagga

SEQ ID NO: 1654 - DNA, 20 bp, Artificial Sequence
  Synthetic
tccgtagaggagcaccagga

SEQ ID NO: 1655 - DNA, 21 bp, Artificial Sequence
  Synthetic
aacgaggcgcaccgggtccca

SEQ ID NO: 1656 - DNA, 15 bp, Artificial Sequence
  Synthetic
tgggacccggtgcgc

SEQ ID NO: 1657 - DNA, 21 bp, Artificial Sequence
  Synthetic
ccgtcacgcctccgggtccca

SEQ ID NO: 1658 - DNA, 15 bp, Artificial Sequence
  Synthetic
tgggacccggaggcg

SEQ ID NO: 1659 - DNA, 21 bp, Artificial Sequence
  Synthetic
aatccgtagaggagcaccagg

SEQ ID NO: 1660 - DNA, 21 bp, Artificial Sequence
  Synthetic
aacgaggcgcaccgggtccca

SEQ ID NO: 1661 - DNA, 30 bp, Artificial Sequence
  Synthetic
ttccttgtttcttaaaaattccatgtctaa

SEQ ID NO: 1662 - DNA, 30 bp, Artificial Sequence
  Synthetic
atttttcgatactttttatagcactccatc

SEQ ID NO: 1663 - DNA, 22 bp, Artificial Sequence
  Synthetic
tggcgtatctgggttccaagtc

SEQ ID NO: 1664 - DNA, 27 bp, Artificial Sequence
  Synthetic
aacgaggcgcacgtcaaatctccctaa

SEQ ID NO: 1665 - DNA, 25 bp, Artificial Sequence
  Synthetic
aacgaggcgcactgggttccaagtc

SEQ ID NO: 1666 - DNA, 22 bp, Artificial Sequence
  Synthetic
ttagggagatttgacgtgcgcc

SEQ ID NO: 1667 - DNA, 20 bp, Artificial Sequence
  Synthetic
gacttggaacccagtgcgcc

SEQ ID NO: 1668 - DNA, 25 bp, Artificial Sequence
  Synthetic
aacgacgcgcactgggttccaagtc

SEQ ID NO: 1669 - DNA, 25 bp, Artificial Sequence
  Synthetic
aacgaggcgcactgggttccaagtc

SEQ ID NO: 1670 - DNA, 18 bp, Artificial Sequence
  Synthetic
gacttggaacccagtgcg

SEQ ID NO: 1671 - DNA, 26 bp, Artificial Sequence
  Synthetic
aacgaggcgcactgggttccaagtcg

SEQ ID NO: 1672 - DNA, 20 bp, Artificial Sequence
  Synthetic
cgacttggaacccagtgcgc

SEQ ID NO: 1673 - DNA, 29 bp, Artificial Sequence
  Synthetic
aacgaggcgcacaaccatcaagttctata

SEQ ID NO: 1674 - DNA, 35 bp, Artificial Sequence
  Synthetic
ggaatcgtcactactgaccctttgggtataaacac

SEQ ID NO: 1675 - DNA, 32 bp, Artificial Sequence
  Synthetic
tcttttttacagactctctcaagtctattacc

SEQ ID NO: 1676 - DNA, 23 bp, Artificial Sequence
  Synthetic
tatagaacttgatggttgtgcgc

SEQ ID NO: 1677 - DNA, 27 bp, Artificial Sequence
  Synthetic
aacgaggcgcacaaccatcaagttcta

SEQ ID NO: 1678 - DNA, 34 bp, Artificial Sequence
  Synthetic
tatcttttttacagactctctcaagtctattacc

SEQ ID NO: 1679 - DNA, 21 bp, Artificial Sequence
  Synthetic
tagaacttgatggttgtgcgc

SEQ ID NO: 1680 - DNA, 23 bp, Artificial Sequence
  Synthetic
cagtcacgtctcctcggcagggc

SEQ ID NO: 1681 - DNA, 29 bp, Artificial Sequence
  Synthetic
cacaatatcgtaggtaggaggtgccttaa

SEQ ID NO: 1682 - DNA, 17 bp, Artificial Sequence
  Synthetic
gccctgccgaggagacg

SEQ ID NO: 1683 - DNA, 22 bp, Artificial Sequence
  Synthetic
cagtcacgtctcctcggcaggg

SEQ ID NO: 1684 - DNA, 19 bp, Artificial Sequence
  Synthetic
ccccatcgatctcctcctg

SEQ ID NO: 1685 - DNA, 16 bp, Artificial Sequence
  Synthetic
ccctgccgaggagacg

SEQ ID NO: 1686 - DNA, 21 bp, Artificial Sequence
  Synthetic
cagtcacgtctcctcggcagg

SEQ ID NO: 1687 - DNA, 18 bp, Artificial Sequence
  Synthetic
gccccatcgatctcctcc

SEQ ID NO: 1688 - DNA, 15 bp, Artificial Sequence
  Synthetic
cctgccgaggagacg

SEQ ID NO: 1689 - DNA, 20 bp, Artificial Sequence
  Synthetic
cagtcacgtctcctcggcag

SEQ ID NO: 1690 - DNA, 18 bp, Artificial Sequence
  Synthetic
ggccccatcgatctcctc

SEQ ID NO: 1691 - DNA, 14 bp, Artificial Sequence
  Synthetic
ctgccgaggagacg

SEQ ID NO: 1692 - DNA, 21 bp, Artificial Sequence
  Synthetic
ccgtcacgcctcctcggcagg

SEQ ID NO: 1693 - DNA, 15 bp, Artificial Sequence
  Synthetic
cctgccgaggaggcg

SEQ ID NO: 1694 - DNA, 18 bp, Artificial Sequence
  Synthetic
gccccatcgatctcctcc

SEQ ID NO: 1695 - DNA, 21 bp, Artificial Sequence
  Synthetic
ccgtcacgcctcctcggcagg

SEQ ID NO: 1696 - DNA, 25 bp, Artificial Sequence
  Synthetic
ccgtcacgcctcggcttgtgtgttc

SEQ ID NO: 1697 - DNA, 24 bp, Artificial Sequence
  Synthetic
ccgggataggttcagggaggcgtc

SEQ ID NO: 1698 - DNA, 18 bp, Artificial Sequence
  Synthetic
ggtttcatgggggtccct

SEQ ID NO: 1699 - DNA, 19 bp, Artificial Sequence
  Synthetic
gaacacacaagccgaggcg

SEQ ID NO: 1700 - DNA, 24 bp, Artificial Sequence
  Synthetic
ccgtcacgcctcgcctttgtttgg

SEQ ID NO: 1701 - DNA, 18 bp, Artificial Sequence
  Synthetic
ccaaacaaaggcgaggcg

SEQ ID NO: 1702 - DNA, 34 bp, Artificial Sequence
  Synthetic
gggcaacattgacataaagtgtttgcgtactctc

SEQ ID NO: 1703 - DNA, 19 bp, Artificial Sequence
  Synthetic
gttcgaattccatgtcatc

SEQ ID NO: 1704 - DNA, 23 bp, Artificial Sequence
  Synthetic
ccgtcacgcctcgcctttgtttg

SEQ ID NO: 1705 - DNA, 17 bp, Artificial Sequence
  Synthetic
caaacaaaggcgaggcg

SEQ ID NO: 1706 - DNA, 20 bp, Artificial Sequence
  Synthetic
ggttcgaattccatgtcatc

SEQ ID NO: 1707 - DNA, 26 bp, Artificial Sequence
  Synthetic
aacgaggcgcacgctcctggaagatg

SEQ ID NO: 1708 - DNA, 21 bp, Artificial Sequence
  Synthetic
catcttccaggagcgtgcgcc

SEQ ID NO: 1709 - DNA, 23 bp, Artificial Sequence
  Synthetic
cacttgattttggagggatctca

SEQ ID NO: 1710 - DNA, 14 bp, Artificial Sequence
  Synthetic
  modified_base (13)..(13): The modified nucleotide at this position is biotinylated thymidin e.
aaaagtggctcctc

SEQ ID NO: 1711 - DNA, 16 bp, Artificial Sequence
  Synthetic
  modified_base (15)..(15): The modified nucleotide at this position is biotinylated thymidin e.
aaaagaggctccgctc

SEQ ID NO: 1712 - DNA, 16 bp, Artificial Sequence
  Synthetic
  modified_base (15)..(15): The modified nucleotide at this position is biotinylated thymidin e.
aaaatgtacgccgctc

SEQ ID NO: 1713 - DNA, 19 bp, Artificial Sequence
  Synthetic
  modified_base (18)..(18): The modified nucleotide at this position is biotinylated thymidin e.
aaaagatacgccacagctc

SEQ ID NO: 1714 - DNA, 20 bp, Artificial Sequence
  Synthetic
  modified_base (19)..(19): The modified nucleotide at this position is biotinylated thymidin e.
aaaaccaaccgtatgaactc

SEQ ID NO: 1715 - DNA, 17 bp, Artificial Sequence
  Synthetic
  modified_base (16)..(16)
aaaatcatacgccactc

SEQ ID NO: 1716 - DNA, 32 bp, Artificial Sequence
  Synthetic
cggaggaagcagttggtgtgcctcgttgcctt

SEQ ID NO: 1717 - DNA, 29 bp, Artificial Sequence
  Synthetic
cggaggaagcagttggtgcccctcgttaa

SEQ ID NO: 1718 - DNA, 29 bp, Artificial Sequence
  Synthetic
cggaagaagcagttggtgcgcctcgttaa

SEQ ID NO: 1719 - DNA, 29 bp, Artificial Sequence
  Synthetic
cggaagaagcagttggtgcgcctcgttaa

SEQ ID NO: 1720 - DNA, 29 bp, Artificial Sequence
  Synthetic
cggaagaagcagttggtgcgcctcgttaa

SEQ ID NO: 1721 - DNA, 29 bp, Artificial Sequence
  Synthetic
cggaagaagcagttggtgcgcctcgttaa

SEQ ID NO: 1722 - DNA, 29 bp, Artificial Sequence
  Synthetic
cggaagaagcagttggtgcgcctcgttaa

SEQ ID NO: 1723 - DNA, 28 bp, Artificial Sequence
  Synthetic
cggaagaagcagttggaggcgtgacggt

SEQ ID NO: 1724 - DNA, 28 bp, Artificial Sequence
  Synthetic
cggaagaagcagttggaggcgtgacgga

SEQ ID NO: 1725 - DNA, 28 bp, Artificial Sequence
  Synthetic
cggaagaagcagttggaggcgtgacgga

SEQ ID NO: 1726 - DNA, 28 bp, Artificial Sequence
  Synthetic
cggaagaagcagttggaggcgtgacggt

SEQ ID NO: 1727 - DNA, 28 bp, Artificial Sequence
  Synthetic
cggaagaagcagttggaggcgtgacggt

SEQ ID NO: 1728 - DNA, 28 bp, Artificial Sequence
  Synthetic
cggaagaagcagttggaggcgtgacggt

SEQ ID NO: 1729 - DNA, 28 bp, Artificial Sequence
  Synthetic
cggaagaagcagttggaggcgtgacgga

SEQ ID NO: 1730 - DNA, 12 bp, Artificial Sequence
  Synthetic
  misc_feature (4)..(4): The residue at this position is linked to a spacer bearing a Cy3 dye.
caacgcttcctc

SEQ ID NO: 1731 - DNA, 13 bp, Artificial Sequence
  Synthetic
  misc_feature (4)..(4): The residue at this position is linked to a spacer bearing a Cy3 dye.
caacgcttcctcc

SEQ ID NO: 1732 - DNA, 14 bp, Artificial Sequence
  Synthetic
  misc_feature (4)..(4): The residue at this position is linked to a spacer bearing a Cy3 dye.
caacgcttcctccg

SEQ ID NO: 1733 - DNA, 16 bp, Artificial Sequence
  Synthetic
  misc_feature (4)..(4): The residue at this position is linked to a spacer bearing a Cy3 dye.
caacgcttcctccguu

SEQ ID NO: 1734 - DNA, 18 bp, Artificial Sequence
  Synthetic
caacgcttcctccguuuu

SEQ ID NO: 1735 - DNA, 14 bp, Artificial Sequence
  Synthetic
  misc_feature (4)..(4): The residue at this position is linked to a spacer bearing a Cy3 dye.
caacgcttcctccg

SEQ ID NO: 1736 - DNA, 31 bp, Artificial Sequence
  Synthetic
  misc_feature (30)..(30): The residue at this position is attached to a C18 linker.
  modified_base (31)..(31): The modified nucleotide at this position is dideoxy cytosine.
cgaaattaatacgccttcttgggcatgtacc

SEQ ID NO: 1737 - DNA, 31 bp, Artificial Sequence; identical to SEQ ID NO: 1736
  Synthetic
  misc_feature (30)..(30): The residue at this position is linked to a C18 linker.
  modified_base (31)..(31): The modified nucleotide at this position is dideoxy cytosine.

SEQ ID NO: 1738 - DNA, 23 bp, Artificial Sequence
  Synthetic
  modified_base (23)..(23): The modified nucleotide at this position is dideoxy cytosine.
ctgaagatgtttcagttctgtgc

SEQ ID NO: 1739 - DNA, 22 bp, Artificial Sequence
  Synthetic
gaagatgtttcagttctgtggc

SEQ ID NO: 1740 - DNA, 27 bp, Artificial Sequence
  Synthetic
tcacttcctaccttcttgggcatgtaa

SEQ ID NO: 1741 - DNA, 30 bp, Artificial Sequence
  Synthetic
tcacttcctaccttcttgggcatgtaaaac

SEQ ID NO: 1742 - DNA, 28 bp, Artificial Sequence
  Synthetic
  misc_feature (27)..(27): The residue at this position is attached to a C18 linker.
  modified_base (28)..(28): The modified nucleotide at this position is dideoxy cytosine.
tcacttcctaccttcttgggcatgtaac

SEQ ID NO: 1743 - DNA, 22 bp, Artificial Sequence
  Synthetic
  modified_base (22)..(22): The modified nucleotide at this position is dideoxy cytosine.
gaagatgtttcagttctgtggc

SEQ ID NO: 1744 - DNA, 27 bp, Artificial Sequence
  Synthetic
acttcctacttaattccattcaaaatc

SEQ ID NO: 1745 - DNA, 28 bp, Artificial Sequence
  Synthetic
  misc_feature (27)..(27): The residue at this position is attached to a C18 linker.
  modified_base (28)..(28): The modified nucleotide at this position is dideoxy cytosine.
acttcctacttaattccattcaaaatcc

SEQ ID NO: 1746 - DNA, 24 bp, Artificial Sequence
  Synthetic
  modified_base (24)..(24): The modified nucleotide at this position is dideoxy cytosine.
gagtttgggattcttgtaattatc

SEQ ID NO: 1747 - DNA, 36 bp, Artificial Sequence
  Synthetic
cgtgttctgtggcgtatcttaattccattcaaaatc

SEQ ID NO: 1748 - DNA, 36 bp, Artificial Sequence; identical to SEQ ID NO: 1747
  Synthetic

SEQ ID NO: 1749 - DNA, 24 bp, Artificial Sequence
  Synthetic
  modified_base (24)..(24): The modified nucleotide at this position is dideoxy cytosine.
gagtttgggattcttgtaattatc

SEQ ID NO: 1750 - DNA, 41 bp, Artificial Sequence
  Synthetic
cgtgttctgtggcgtatcttaattccattcaaaatcatctg

SEQ ID NO: 1751 - DNA, 41 bp, Artificial Sequence; identical to SEQ ID NO: 1750
  Synthetic

SEQ ID NO: 1752 - DNA, 39 bp, Artificial Sequence
  Synthetic
cgtgttctgtggcgtatcttaattccattcaaaatcatc

SEQ ID NO: 1753 - DNA, 39 bp, Artificial Sequence; identical to SEQ ID NO: 1752
  Synthetic

SEQ ID NO: 1754 - DNA, 24 bp, Artificial Sequence
  Synthetic
  modified_base (24)..(24): The modified nucleotide at this position is dideoxy cytosine.
gagtttgggattcttgtaattatc

SEQ ID NO: 1755 - DNA, 25 bp, Artificial Sequence
  Synthetic
ttcctactcttgatcttcattgtgc

SEQ ID NO: 1756 - DNA, 21 bp, Artificial Sequence
  Synthetic
ctcaggaggagcaatgatctt

SEQ ID NO: 1757 - DNA, 18 bp, Artificial Sequence
  Synthetic
ctcaggaggagcaatgat

SEQ ID NO: 1758 - DNA, 29 bp, Artificial Sequence
  Synthetic
  misc_feature (28)..(28): The residue at this position is attached to a C18 linker.
  modified_base (29)..(29): The modified nucleotide at this position is dideoxy cytosine.
tcacttcctactctgggtcatcttctcgc

SEQ ID NO: 1759 - DNA, 29 bp, Artificial Sequence
  Synthetic
  misc_feature (28)..(28): The residue at this position is attached to a C18 linker.
  modified_base (28)..(28): The modified nucleotide at this position is dideoxy cytosine.
tcacttcctactctgggtcatcttctcgc

SEQ ID NO: 1760 - DNA, 24 bp, Artificial Sequence
  Synthetic
  modified_base (24)..(24): The modified nucleotide at this position is dideoxy cytosine.
gtgttgaaggtctcaaacatgatc

SEQ ID NO: 1761 - DNA, 26 bp, Artificial Sequence
  Synthetic
  modified_base (26)..(26): The modified nucleotide at this position is dideoxy cytosine.
gggtgttgaaggtctcaaacatgatc

SEQ ID NO: 1762 - DNA, 33 bp, Artificial Sequence
  Synthetic
cgtgttctgtggcgtatctgggtcatcttctcg

SEQ ID NO: 1763 - DNA, 33 bp, Artificial Sequence; identical to SEQ ID NO: 1762
  Synthetic

SEQ ID NO: 1764 - DNA, 26 bp, Artificial Sequence
  Synthetic
  modified_base (26)..(26): The modified nucleotide at this position is dideoxy cytosine.
gggtgttgaaggtctcaaacatgatc

SEQ ID NO: 1765 - DNA, 28 bp, Artificial Sequence
  Synthetic
ttcatacggttggtagttgaggtcaatg

SEQ ID NO: 1766 - DNA, 28 bp, Artificial Sequence
  Synthetic
ttcatacggttggtagttgaggtcaatg

SEQ ID NO: 1767 - DNA, 28 bp, Artificial Sequence
  Synthetic
ggaatcatattggaacatgtaaaccatc

SEQ ID NO: 1768 - DNA, 26 bp, Artificial Sequence
  Synthetic
ttcatacggttggctcctggaagatg

SEQ ID NO: 1769 - DNA, 26 bp, Artificial Sequence
  Synthetic
ttcatacggttggctcctggaagatg

SEQ ID NO: 1770 - DNA, 23 bp, Artificial Sequence
  Synthetic
cacttgattttggagggatctca

SEQ ID NO: 1771 - DNA, 28 bp, Artificial Sequence
  Synthetic
ttcatacggttggtagttgaggtcaatg

SEQ ID NO: 1772 - DNA, 28 bp, Artificial Sequence
  Synthetic
agaatcatactggaacatgtagaccatc

SEQ ID NO: 1773 - DNA, 19 bp, Artificial Sequence
  Synthetic
tggcgtatcatgtagttga

SEQ ID NO: 1774 - DNA, 19 bp, Artificial Sequence
  Synthetic
tggcgtatcatgtagttga

SEQ ID NO: 1775 - DNA, 25 bp, Artificial Sequence
  Synthetic
ggagtcatactggaacatgtagacc

SEQ ID NO: 1776 - DNA, 19 bp, Artificial Sequence
  Synthetic
tggcgtatcatgtagttga

SEQ ID NO: 1777 - DNA, 23 bp, Artificial Sequence
  Synthetic
agtcatactggaacatgtagaca

SEQ ID NO: 1778 - DNA, 25 bp, Artificial Sequence
  Synthetic
ggagtcatactggaacatgtagaca

SEQ ID NO: 1779 - DNA, 21 bp, Artificial Sequence
  Synthetic
tggcgtatctcttttctcatt

SEQ ID NO: 1780 - DNA, 21 bp, Artificial Sequence
  Synthetic
tggcgtatctcttttctcatt

SEQ ID NO: 1781 - DNA, 26 bp, Artificial Sequence
  Synthetic
acaatcagaattgccattgcacaaca

SEQ ID NO: 1782 - DNA, 21 bp, Artificial Sequence
  Synthetic
gaaggcagaggaccgtgaggc

SEQ ID NO: 1783 - DNA, 21 bp, Artificial Sequence
  Synthetic
gaaggcagaggaccgtgaggc

SEQ ID NO: 1784 - DNA, 22 bp, Artificial Sequence
  Synthetic
aagacatctggtgttgtagtga

SEQ ID NO: 1785 - DNA, 23 bp, Artificial Sequence
  Synthetic
tggcgtatctccccagagaaagc

SEQ ID NO: 1786 - DNA, 23 bp, Artificial Sequence
  Synthetic
tggcgtatctccccagagaaagc

SEQ ID NO: 1787 - DNA, 25 bp, Artificial Sequence
  Synthetic
cactgagccgatgaagcgatggtaa

SEQ ID NO: 1788 - DNA, 23 bp, Artificial Sequence
  Synthetic
tggcgtatctagggctccaagag

SEQ ID NO: 1789 - DNA, 23 bp, Artificial Sequence
  Synthetic
tggcgtatctagggctccaagag

SEQ ID NO: 1790 - DNA, 25 bp, Artificial Sequence
  Synthetic
gtgttcaggttttggaggcggataa

SEQ ID NO: 1791 - DNA, 21 bp, Artificial Sequence
  Synthetic
tggcgtatctagggctccaag

SEQ ID NO: 1792 - DNA, 21 bp, Artificial Sequence
  Synthetic
tggcgtatctagggctccaag

SEQ ID NO: 1793 - DNA, 25 bp, Artificial Sequence
  Synthetic
gtgttcaggttttggaggcggataa

SEQ ID NO: 1794 - DNA, 11 bp, Artificial Sequence
  Synthetic
  misc_feature (4)..(4): The residue at this position is linked to a spacer bearing a Cy3 dye.
attctctcaga

SEQ ID NO: 1795 - DNA, 12 bp, Artificial Sequence
  Synthetic
  misc_feature (4)..(4): The residue at this position is linked to a spacer bearing a Cy3 dye.
attctctcagac

SEQ ID NO: 1796 - DNA, 13 bp, Artificial Sequence
  Synthetic
  misc_feature (4)..(4): The residue at this position is linked to a spacer bearing a Cy3 dye.
attctctcagact

SEQ ID NO: 1797 - DNA, 26 bp, Artificial Sequence
  Synthetic
cagtctgagatgaatgatacgccagg

SEQ ID NO: 1798 - DNA, 16 bp, Artificial Sequence
  Synthetic
cttggagccctagata

SEQ ID NO: 1799 - DNA, 15 bp, Artificial Sequence
  Synthetic
cttggagccctagat

SEQ ID NO: 1800 - DNA, 14 bp, Artificial Sequence
  Synthetic
cttggagccctaga

SEQ ID NO: 1801 - DNA, 20 bp, Artificial Sequence
  Synthetic
ctggcgtatctagggctcca

SEQ ID NO: 1802 - DNA, 21 bp, Artificial Sequence
  Synthetic
cctggcgtatctagggctcca

SEQ ID NO: 1803 - DNA, 25 bp, Artificial Sequence
  Synthetic
gtgttcaggttttggaggcggataa

SEQ ID NO: 1804 - DNA, 26 bp, Artificial Sequence
  Synthetic
cagtctgagatgaatgatacgccagg

SEQ ID NO: 1805 - DNA, 15 bp, Artificial Sequence
  Synthetic
cttggagccctagat

SEQ ID NO: 1806 - DNA, 22 bp, Artificial Sequence
  Synthetic
ctctctcgtctctagggctcca

SEQ ID NO: 1807 - DNA, 22 bp, Artificial Sequence
  Synthetic
ctctctcgtctctagggctcca

SEQ ID NO: 1808 - DNA, 25 bp, Artificial Sequence
  Synthetic
gtgttcaggttttggaggcggataa

SEQ ID NO: 1809 - DNA, 28 bp, Artificial Sequence
  Synthetic
cagtctgagatgaatgagacgagagagt

SEQ ID NO: 1810 - DNA, 15 bp, Artificial Sequence
  Synthetic
cttggagccctagag

SEQ ID NO: 1811 - DNA, 19 bp, Artificial Sequence
  Synthetic
tggcgtatctagggctcca

SEQ ID NO: 1812 - DNA, 19 bp, Artificial Sequence
  Synthetic
tggcgtatctagggctcca

SEQ ID NO: 1813 - DNA, 25 bp, Artificial Sequence
  Synthetic
gtgttcaggttttggaggcggataa

SEQ ID NO: 1814 - DNA, 21 bp, Artificial Sequence
  Synthetic
tggcgtatctccccagagaaa

SEQ ID NO: 1815 - DNA, 19 bp, Artificial Sequence
  Synthetic
tggcgtatctccccagaga

SEQ ID NO: 1816 - DNA, 25 bp, Artificial Sequence
  Synthetic
cactgagccgatgaagcgatggtaa

SEQ ID NO: 1817 - DNA, 19 bp, Artificial Sequence
  Synthetic
tggcgtatctatagggctc

SEQ ID NO: 1818 - DNA, 25 bp, Artificial Sequence
  Synthetic
gtgtgttcaggttttggaggcggaa

SEQ ID NO: 1819 - DNA, 23 bp, Artificial Sequence
  Synthetic
ctctctcgtctcttcaggttttg

SEQ ID NO: 1820 - DNA, 23 bp, Artificial Sequence
  Synthetic
ggcagctctcaggtcaggtgtga

SEQ ID NO: 1821 - DNA, 24 bp, Artificial Sequence
  Synthetic
aggcagctctcaggtcaggtgtga

SEQ ID NO: 1822 - DNA, 28 bp, Artificial Sequence
  Synthetic
cagtctgagatgaatgagacgagagagt

SEQ ID NO: 1823 - DNA, 12 bp, Artificial Sequence
  Synthetic
  misc_feature (4)..(4): The residue at this position is linked to a spacer bearing a Cy3 dye.
attctctcagac

SEQ ID NO: 1824 - DNA, 15 bp, Artificial Sequence
  Synthetic
caaaacctgaagaga

SEQ ID NO: 1825 - DNA, 16 bp, Artificial Sequence
  Synthetic
caaaacctgaagagac

SEQ ID NO: 1826 - DNA, 17 bp, Artificial Sequence
  Synthetic
caaaacctgaagagacg

SEQ ID NO: 1827 - DNA, 23 bp, Artificial Sequence
  Synthetic
ctctctcgtctcttcaggttttg

SEQ ID NO: 1828 - DNA, 23 bp, Artificial Sequence
  Synthetic
ctctctcgtctcttcaggttttg

SEQ ID NO: 1829 - DNA, 23 bp, Artificial Sequence
  Synthetic
ggcagctctcaggtcaggtgtga

SEQ ID NO: 1830 - DNA, 17 bp, Artificial Sequence
  Synthetic
gaggcggatatagggct

SEQ ID NO: 1831 - DNA, 23 bp, Artificial Sequence
  Synthetic
ctctctcgtcttctaaggactta

SEQ ID NO: 1832 - DNA, 24 bp, Artificial Sequence
  Synthetic
ctctctcgtcttctaaggacttac

SEQ ID NO: 1833 - DNA, 25 bp, Artificial Sequence
  Synthetic
gaaacaggagtgcaaggaccagaca

SEQ ID NO: 1834 - DNA, 20 bp, Artificial Sequence
  Synthetic
tcacgtctcttcaggttttg

SEQ ID NO: 1835 - DNA, 21 bp, Artificial Sequence
  Synthetic
gtcacgtctcttcaggttttg

SEQ ID NO: 1836 - DNA, 22 bp, Artificial Sequence
  Synthetic
agtcacgtctcttcaggttttg

SEQ ID NO: 1837 - DNA, 23 bp, Artificial Sequence
  Synthetic
cagtcacgtctcttcaggttttg

SEQ ID NO: 1838 - DNA, 24 bp, Artificial Sequence
  Synthetic
aggcagctctcaggtcaggtgtga

SEQ ID NO: 1839 - DNA, 14 bp, Artificial Sequence
  Synthetic
  misc_feature (4)..(4): The residue at this position is linked to a spacer bearing a Cy3 dye.
caacgcttcctccg

SEQ ID NO: 1840 - DNA, 30 bp, Artificial Sequence
  Synthetic
cggaggaagcagttggagacgtgactgtgg

SEQ ID NO: 1841 - DNA, 30 bp, Artificial Sequence
  Synthetic
cggaagaagcagttggagacgtgactgtgg

SEQ ID NO: 1842 - DNA, 30 bp, Artificial Sequence
  Synthetic
cggacgaagcagttggagacgtgactgtgg

SEQ ID NO: 1843 - DNA, 14 bp, Artificial Sequence
  Synthetic
  misc_feature (4)..(4): The residue at this position is linked to a spacer bearing a Cy3 dye.
caacgcttcctccg

SEQ ID NO: 1844 - DNA, 29 bp, Artificial Sequence
  Synthetic
cggaagaagcagttggtgcgcctcgttaa

SEQ ID NO: 1845 - DNA, 14 bp, Artificial Sequence
  Synthetic
  misc_feature (4)..(4): The residue at this position is linked to a spacer bearing a Cy3 dye.
caacgcttcctccg

SEQ ID NO: 1846 - DNA, 28 bp, Artificial Sequence
  Synthetic
cggaagaagcagttggaggcgtgacggt

SEQ ID NO: 1847 - DNA, 24 bp, Artificial Sequence
  Synthetic
aacgaggcgcacgatgtccatcga

SEQ ID NO: 1848 - DNA, 24 bp, Artificial Sequence
  Synthetic
ttcttggtgttcttttactttctc

SEQ ID NO: 1849 - DNA, 28 bp, Artificial Sequence
  Synthetic
gcaatcaataaagtcccgagggttgttc

SEQ ID NO: 1850 - DNA, 18 bp, Artificial Sequence
  Synthetic
tcgatggacatcgtgcgc

SEQ ID NO: 1851 - DNA, 22 bp, Artificial Sequence
  Synthetic
ccgtcacgcctctcacccatct

SEQ ID NO: 1852 - DNA, 15 bp, Artificial Sequence
  Synthetic
ctggtcgccgcacct

SEQ ID NO: 1853 - DNA, 21 bp, Artificial Sequence
  Synthetic
tgtagggcatgtgagcctgga

SEQ ID NO: 1854 - DNA, 16 bp, Artificial Sequence
  Synthetic
agatgggagagaggcg

SEQ ID NO: 1855 - DNA, 22 bp, Artificial Sequence
  Synthetic
ccgtcacgcctcgaagccctgt

SEQ ID NO: 1856 - DNA, 27 bp, Artificial Sequence
  Synthetic
acttcgatgtcacgggatgtcatatgg

SEQ ID NO: 1857 - DNA, 25 bp, Artificial Sequence
  Synthetic
gagtgtcgttcccttagggatgcgc

SEQ ID NO: 1858 - DNA, 16 bp, Artificial Sequence
  Synthetic
acagggcttcgaggcg

SEQ ID NO: 1859 - DNA, 25 bp, Artificial Sequence
  Synthetic
ccgtcacgcctccctgctgagaaag

SEQ ID NO: 1860 - DNA, 15 bp, Artificial Sequence
  Synthetic
gcaggaaggcctccg

SEQ ID NO: 1861 - DNA, 20 bp, Artificial Sequence
  Synthetic
cccgaggcatgcacggcgga

SEQ ID NO: 1862 - DNA, 19 bp, Artificial Sequence
  Synthetic
ctttctcagcagggaggcg

SEQ ID NO: 1863 - DNA, 24 bp, Artificial Sequence
  Synthetic
ccgtcacgcctccctgctgagaaa

SEQ ID NO: 1864 - DNA, 24 bp, Artificial Sequence
  Synthetic
ccgtcacgcctccctgctgagaaa

SEQ ID NO: 1865 - DNA, 24 bp, Artificial Sequence
  Synthetic
ccgtcacgcctccctgctgagaaa

SEQ ID NO: 1866 - DNA, 20 bp, Artificial Sequence
  Synthetic
cccgaggcatgcacggcgga

SEQ ID NO: 1867 - DNA, 15 bp, Artificial Sequence
  Synthetic
ggcaggaaggcctcc

SEQ ID NO: 1868 - DNA, 18 bp, Artificial Sequence
  Synthetic
tttctcagcagggaggcg

SEQ ID NO: 1869 - DNA, 22 bp, Artificial Sequence
  Synthetic
ccgtcacgcctccctgctgaga

SEQ ID NO: 1870 - DNA, 17 bp, Artificial Sequence
  Synthetic
aaggcaggaaggcctcc

SEQ ID NO: 1871 - DNA, 16 bp, Artificial Sequence
  Synthetic
tctcagcagggaggcg

SEQ ID NO: 1872 - DNA, 23 bp, Artificial Sequence
  Synthetic
ccgtcacgcctccctgctgagaa

SEQ ID NO: 1873 - DNA, 16 bp, Artificial Sequence
  Synthetic
aggcaggaaggcctgg

SEQ ID NO: 1874 - DNA, 17 bp, Artificial Sequence
  Synthetic
ttctcagcagggaggcg

SEQ ID NO: 1875 - DNA, 25 bp, Artificial Sequence
  Synthetic
ccgtcacgcctccctgctgagaaag

SEQ ID NO: 1876 - DNA, 15 bp, Artificial Sequence
  Synthetic
gcaggaaggcctccg

SEQ ID NO: 1877 - DNA, 19 bp, Artificial Sequence
  Synthetic
ctttctcagcagggaggcg

SEQ ID NO: 1878 - DNA, 23 bp, Artificial Sequence
  Synthetic
aacgaggcgcaccaccatatccc

SEQ ID NO: 1879 - DNA, 27 bp, Artificial Sequence
  Synthetic
ccagcggtttccattggcaaagatcaa

SEQ ID NO: 1880 - DNA, 21 bp, Artificial Sequence
  Synthetic
cggaagaatgggtcgaccatg

SEQ ID NO: 1881 - DNA, 17 bp, Artificial Sequence
  Synthetic
gggatatggtggtgcgc

SEQ ID NO: 1882 - DNA, 23 bp, Artificial Sequence
  Synthetic
ccgtcacgcctccaccatatccc

SEQ ID NO: 1883 - DNA, 23 bp, Artificial Sequence
  Synthetic
ccgtcacgcctccaccatatccc

SEQ ID NO: 1884 - DNA, 23 bp, Artificial Sequence
  Synthetic
ccgtcacgcctccaccatatccc

SEQ ID NO: 1885 - DNA, 17 bp, Artificial Sequence
  Synthetic
gggatatggtggaggcg

SEQ ID NO: 1886 - DNA, 25 bp, Artificial Sequence
  Synthetic
aacgaggcgcaccagagctgatgag

SEQ ID NO: 1887 - DNA, 29 bp, Artificial Sequence
  Synthetic
gagaagagctcaaacagctggccgaataa

SEQ ID NO: 1888 - DNA, 28 bp, Artificial Sequence
  Synthetic
tgaaaaagtctggtagaacaagttcagc

SEQ ID NO: 1889 - DNA, 19 bp, Artificial Sequence
  Synthetic
ctcatcagctctggtgcgc

SEQ ID NO: 1890 - DNA, 25 bp, Artificial Sequence
  Synthetic
ccgtcacgcctccagagctgatgag

SEQ ID NO: 1891 - DNA, 19 bp, Artificial Sequence
  Synthetic
ctcatcagctctggaggcg

SEQ ID NO: 1892 - DNA, 23 bp, Artificial Sequence
  Synthetic
aacgaggcgcacccttggatttc

SEQ ID NO: 1893 - DNA, 27 bp, Artificial Sequence
  Synthetic
ctgttcaatctccctgtagactctcta

SEQ ID NO: 1894 - DNA, 17 bp, Artificial Sequence
  Synthetic
cgaagctcctctatcag

SEQ ID NO: 1895 - DNA, 17 bp, Artificial Sequence
  Synthetic
gaaatccaagggtgcgc

SEQ ID NO: 1896 - DNA, 23 bp, Artificial Sequence
  Synthetic
ccgtcacgcctcccttggatttc

SEQ ID NO: 1897 - DNA, 17 bp, Artificial Sequence
  Synthetic
gaaatccaagggaggcg

SEQ ID NO: 1898 - DNA, 20 bp, Artificial Sequence
  Synthetic
aacgaggcgcactgagggcc

SEQ ID NO: 1899 - DNA, 22 bp, Artificial Sequence
  Synthetic
ggaagaggaaggtggggtccaa

SEQ ID NO: 1900 - DNA, 17 bp, Artificial Sequence
  Synthetic
cccttggatttccgaag

SEQ ID NO: 1901 - DNA, 14 bp, Artificial Sequence
  Synthetic
ggccctcagtgcgc

SEQ ID NO: 1902 - DNA, 20 bp, Artificial Sequence
  Synthetic
ccgtcacgcctctgagggcc

SEQ ID NO: 1903 - DNA, 14 bp, Artificial Sequence
  Synthetic
ggccctcagaggcg

SEQ ID NO: 1904 - DNA, 24 bp, Artificial Sequence
  Synthetic
aacgaggcgcacaatacagagctg

SEQ ID NO: 1905 - DNA, 25 bp, Artificial Sequence
  Synthetic
gagaagagctcaaacagctggccgc

SEQ ID NO: 1906 - DNA, 24 bp, Artificial Sequence
  Synthetic
atgagtgaaaaagtctggtagaac

SEQ ID NO: 1907 - DNA, 18 bp, Artificial Sequence
  Synthetic
cagctctgtattgtgcgc

SEQ ID NO: 1908 - DNA, 24 bp, Artificial Sequence
  Synthetic
ccgtcacgcctcaatacagagctg

SEQ ID NO: 1909 - DNA, 18 bp, Artificial Sequence
  Synthetic
cagctctgtattgaggcg

SEQ ID NO: 1910 - DNA, 25 bp, Artificial Sequence
  Synthetic
aacgaggcgcacggttgaggttctg

SEQ ID NO: 1911 - DNA, 28 bp, Artificial Sequence
  Synthetic
cagcaaagaagagcgagagcgtgttgac

SEQ ID NO: 1912 - DNA, 18 bp, Artificial Sequence
  Synthetic
gtggctgaattcactgtg

SEQ ID NO: 1913 - DNA, 19 bp, Artificial Sequence
  Synthetic
cagaacctcaaccgtgcgc

SEQ ID NO: 1914 - DNA, 25 bp, Artificial Sequence
  Synthetic
ccgtcacgcctcggttgaggttctg

SEQ ID NO: 1915 - DNA, 19 bp, Artificial Sequence
  Synthetic
cagaacctcaaccgaggcg

SEQ ID NO: 1916 - DNA, 25 bp, Artificial Sequence
  Synthetic
ccgtcacgcctccaccatatccccg

SEQ ID NO: 1917 - DNA, 23 bp, Artificial Sequence
  Synthetic
ccgtcacgcctccaccatatccc

SEQ ID NO: 1918 - DNA, 17 bp, Artificial Sequence
  Synthetic
cggaagaatgggtcgac

SEQ ID NO: 1919 - DNA, 21 bp, Artificial Sequence
  Synthetic
cggaagaatgggtcgaccatg

SEQ ID NO: 1920 - DNA, 17 bp, Artificial Sequence
  Synthetic
gggatatggtggaggcg

SEQ ID NO: 1921 - DNA, 27 bp, Artificial Sequence
  Synthetic
ccagcggtttccattggcaaagatcaa

SEQ ID NO: 1922 - DNA, 19 bp, Artificial Sequence
  Synthetic
cggggatatggtggaggcg

SEQ ID NO: 1923 - DNA, 25 bp, Artificial Sequence
  Synthetic
ccgtcacgcctccagagctgatgag

SEQ ID NO: 1924 - DNA, 29 bp, Artificial Sequence
  Synthetic
gagaagagctcaaacagctggccgaataa

SEQ ID NO: 1925 - DNA, 28 bp, Artificial Sequence
  Synthetic
tgaaaaagtctggtagaacaagttcagc

SEQ ID NO: 1926 - DNA, 19 bp, Artificial Sequence
  Synthetic
ctcatcagctctggaggcg

SEQ ID NO: 1927 - DNA, 23 bp, Artificial Sequence
  Synthetic
ccgtcacgcctcagatgactgcc

SEQ ID NO: 1928 - DNA, 31 bp, Artificial Sequence
  Synthetic
ggagaaggtcggaaaatctctgaatctcatc

SEQ ID NO: 1929 - DNA, 24 bp, Artificial Sequence
  Synthetic
tctgtgtatggcattttggctcgg

SEQ ID NO: 1930 - DNA, 17 bp, Artificial Sequence
  Synthetic
ggcagtcatctgaggcg

SEQ ID NO: 1931 - DNA, 28 bp, Artificial Sequence
  Synthetic
ccgtcacgcctccatccttaatatctat

SEQ ID NO: 1932 - DNA, 26 bp, Artificial Sequence
  Synthetic
gagagattggttaaggatttgctgaa

SEQ ID NO: 1933 - DNA, 25 bp, Artificial Sequence
  Synthetic
ctgtaggatatttccaatcactggg

SEQ ID NO: 1934 - DNA, 22 bp, Artificial Sequence
  Synthetic
atagatattaaggatggaggcg

SEQ ID NO: 1935 - DNA, 22 bp, Artificial Sequence
  Synthetic
aacgaggcgcaccgttccaggc

SEQ ID NO: 1936 - DNA, 24 bp, Artificial Sequence
  Synthetic
catatccatgcagcaccaccatga

SEQ ID NO: 1937 - DNA, 25 bp, Artificial Sequence
  Synthetic
caaaatacagagtgaacacagggcc

SEQ ID NO: 1938 - DNA, 16 bp, Artificial Sequence
  Synthetic
gcctggaacggtgcgc

SEQ ID NO: 1939 - DNA, 21 bp, Artificial Sequence
  Synthetic
aacgaggcgcaccgttccagg

SEQ ID NO: 1940 - DNA, 24 bp, Artificial Sequence
  Synthetic
catatccatgcagcaccaccatga

SEQ ID NO: 1941 - DNA, 26 bp, Artificial Sequence
  Synthetic
ccaaaatacagagtgaacacagggcc

SEQ ID NO: 1942 - DNA, 15 bp, Artificial Sequence
  Synthetic
cctggaacggtgcgc

SEQ ID NO: 1943 - DNA, 22 bp, Artificial Sequence
  Synthetic
aacgaggcgcaccgttccaggc

SEQ ID NO: 1944 - DNA, 22 bp, Artificial Sequence
  Synthetic
aacgaggcgcaccgttccaggc

SEQ ID NO: 1945 - DNA, 22 bp, Artificial Sequence
  Synthetic
aacgaggcgcaccgttccaggc

SEQ ID NO: 1946 - DNA, 25 bp, Artificial Sequence
  Synthetic
caaaatacagagtgaacacagggcc

SEQ ID NO: 1947 - DNA, 16 bp, Artificial Sequence
  Synthetic
gcctggaacggtgcgc

SEQ ID NO: 1948 - DNA, 27 bp, Artificial Sequence
  Synthetic
ccgtcacgcctcagattgactatgctg

SEQ ID NO: 1949 - DNA, 27 bp, Artificial Sequence
  Synthetic
cagtaacctccccaaactcattgcttc

SEQ ID NO: 1950 - DNA, 19 bp, Artificial Sequence
  Synthetic
agcagctcttggtcatcgt

SEQ ID NO: 1951 - DNA, 21 bp, Artificial Sequence
  Synthetic
cagcatagtcaatctgaggcg

SEQ ID NO: 1952 - DNA, 25 bp, Artificial Sequence
  Synthetic
aacgaggcgcactgacattctccac

SEQ ID NO: 1953 - DNA, 21 bp, Artificial Sequence
  Synthetic
gtccacagcattccctgagga

SEQ ID NO: 1954 - DNA, 19 bp, Artificial Sequence
  Synthetic
aaagtccttgctgctcttc

SEQ ID NO: 1955 - DNA, 19 bp, Artificial Sequence
  Synthetic
gtggagaatgtcagtgcgc

SEQ ID NO: 1956 - DNA, 24 bp, Artificial Sequence
  Synthetic
aacgaggcgcactggcttgacaca

SEQ ID NO: 1957 - DNA, 23 bp, Artificial Sequence
  Synthetic
gtcaatgtccttgggagccaaaa

SEQ ID NO: 1958 - DNA, 22 bp, Artificial Sequence
  Synthetic
gagaagttctggaggatggtgg

SEQ ID NO: 1959 - DNA, 18 bp, Artificial Sequence
  Synthetic
tgtgtcaagccagtgcgc

SEQ ID NO: 1960 - DNA, 25 bp, Artificial Sequence
  Synthetic
aacgaggcgcactggcttgacacag

SEQ ID NO: 1961 - DNA, 21 bp, Artificial Sequence
  Synthetic
agaagttctggaggatggtgg

SEQ ID NO: 1962 - DNA, 19 bp, Artificial Sequence
  Synthetic
ctgtgtcaagccagtgcgc

SEQ ID NO: 1963 - DNA, 28 bp, Artificial Sequence
  Synthetic
aacgaggcgcacgaggaacaattcattt

SEQ ID NO: 1964 - DNA, 25 bp, Artificial Sequence
  Synthetic
gttctggaggatggtggtgaagaac

SEQ ID NO: 1965 - DNA, 15 bp, Artificial Sequence
  Synthetic
cgggcaatgccttcg

SEQ ID NO: 1966 - DNA, 22 bp, Artificial Sequence
  Synthetic
aaatgaattgttcctcgtgcgc

SEQ ID NO: 1967 - DNA, 29 bp, Artificial Sequence
  Synthetic
aacgaggcgcacgaggaacaattcatttc

SEQ ID NO: 1968 - DNA, 14 bp, Artificial Sequence
  Synthetic
gggcaatgccttcg

SEQ ID NO: 1969 - DNA, 23 bp, Artificial Sequence
  Synthetic
gaaatgaattgttcctcgtgcgc

SEQ ID NO: 1970 - DNA, 25 bp, Artificial Sequence
  Synthetic
aacgaggcgcacagctgagaagcag

SEQ ID NO: 1971 - DNA, 19 bp, Artificial Sequence
  Synthetic
gcctcagccggatcaccgc

SEQ ID NO: 1972 - DNA, 19 bp, Artificial Sequence
  Synthetic
gcctcagcccgatcaccgc

SEQ ID NO: 1973 - DNA, 21 bp, Artificial Sequence
  Synthetic
atctggtacgttggaggtatt

SEQ ID NO: 1974 - DNA, 21 bp, Artificial Sequence
  Synthetic
atctggtatgttggaggtatt

SEQ ID NO: 1975 - DNA, 19 bp, Artificial Sequence
  Synthetic
ctgcttctcagctctgcgc

SEQ ID NO: 1976 - DNA, 27 bp, Artificial Sequence
  Synthetic
ccgtcacgcctcgtcgaaacgtttgtt

SEQ ID NO: 1977 - DNA, 25 bp, Artificial Sequence
  Synthetic
cctcagacacttcttgtcattgtac

SEQ ID NO: 1978 - DNA, 26 bp, Artificial Sequence
  Synthetic
gaagaggatatccgcaatgacattgc

SEQ ID NO: 1979 - DNA, 21 bp, Artificial Sequence
  Synthetic
aacaaacgtttcgacgaggcg

SEQ ID NO: 1980 - DNA, 31 bp, Artificial Sequence
  Synthetic
ccgtcacgcctcgtcgaaacgtttgttgaag

SEQ ID NO: 1981 - DNA, 25 bp, Artificial Sequence
  Synthetic
cttcaacaaacgtttcgacgaggcg

SEQ ID NO: 1982 - DNA, 25 bp, Artificial Sequence
  Synthetic
ccgtcacgcctcctccatctctatg

SEQ ID NO: 1983 - DNA, 23 bp, Artificial Sequence
  Synthetic
gttcttggctgtgtttttcctta

SEQ ID NO: 1984 - DNA, 20 bp, Artificial Sequence
  Synthetic
aggagacagtcagtcacatc

SEQ ID NO: 1985 - DNA, 19 bp, Artificial Sequence
  Synthetic
catagagatggaggaggcg

SEQ ID NO: 1986 - DNA, 27 bp, Artificial Sequence
  Synthetic
ccgtcacgcctcctccatctctatgag

SEQ ID NO: 1987 - DNA, 21 bp, Artificial Sequence
  Synthetic
ctcatagagatggaggaggcg

SEQ ID NO: 1988 - DNA, 26 bp, Artificial Sequence
  Synthetic
ccgtcacgcctcctcttcaatttctg

SEQ ID NO: 1989 - DNA, 26 bp, Artificial Sequence
  Synthetic
ccctgtcaatttcttcatgaagttta

SEQ ID NO: 1990 - DNA, 23 bp, Artificial Sequence
  Synthetic
ggtatttcatgaggatcaggagc

SEQ ID NO: 1991 - DNA, 21 bp, Artificial Sequence
  Synthetic
ccagaaattgaagaggaggcg

SEQ ID NO: 1992 - DNA, 26 bp, Artificial Sequence
  Synthetic
ccgtcacgcctcctcttcaatttctg

SEQ ID NO: 1993 - DNA, 26 bp, Artificial Sequence
  Synthetic
ccgtcacgcctcctcttcaatttctg

SEQ ID NO: 1994 - DNA, 27 bp, Artificial Sequence
  Synthetic
ccgtcacgcctcctcttcaatttctgg

SEQ ID NO: 1995 - DNA, 20 bp, Artificial Sequence
  Synthetic
cagaaattgaagaggaggcg

SEQ ID NO: 1996 - DNA, 25 bp, Artificial Sequence
  Synthetic
ccgtcacgcctcctcttcaatttct

SEQ ID NO: 1997 - DNA, 26 bp, Artificial Sequence
  Synthetic
ccctgtcaatttcttcatgaagttta

SEQ ID NO: 1998 - DNA, 23 bp, Artificial Sequence
  Synthetic
gggtatttcatgaggatcaggag

SEQ ID NO: 1999 - DNA, 19 bp, Artificial Sequence
  Synthetic
agaaattgaagaggaggcg

SEQ ID NO: 2000 - DNA, 22 bp, Artificial Sequence
  Synthetic
ccgtcacgcctcgttcctgggt

SEQ ID NO: 2001 - DNA, 23 bp, Artificial Sequence
  Synthetic
gagcaaacctcatgccaatgcac

SEQ ID NO: 2002 - DNA, 23 bp, Artificial Sequence
  Synthetic
gagcaaacctcatgtcaatgcac

SEQ ID NO: 2003 - DNA, 23 bp, Artificial Sequence
  Synthetic
gagcaaacctcatgccaatacac

SEQ ID NO: 2004 - DNA, 17 bp, Artificial Sequence
  Synthetic
ccatttccaaagggcag

SEQ ID NO: 2005 - DNA, 16 bp, Artificial Sequence
  Synthetic
ccattcccaagggcag

SEQ ID NO: 2006 - DNA, 16 bp, Artificial Sequence
  Synthetic
acccaggaacgaggcg

SEQ ID NO: 2007 - DNA, 23 bp, Artificial Sequence
  Synthetic
ccgtcacgcctcgttcctgggtc

SEQ ID NO: 2008 - DNA, 17 bp, Artificial Sequence
  Synthetic
gacccaggaacgaggcg

SEQ ID NO: 2009 - DNA, 25 bp, Artificial Sequence
  Synthetic
ccgtcacgcctctgagagcaaacct

SEQ ID NO: 2010 - DNA, 20 bp, Artificial Sequence
  Synthetic
agagcgagtttcatattcaa

SEQ ID NO: 2011 - DNA, 20 bp, Artificial Sequence
  Synthetic
agagcaactttcatgttcaa

SEQ ID NO: 2012 - DNA, 20 bp, Artificial Sequence
  Synthetic
acagcaagtttcatgctgaa

SEQ ID NO: 2013 - DNA, 19 bp, Artificial Sequence
  Synthetic
catgccaatgcagttcctg

SEQ ID NO: 2014 - DNA, 19 bp, Artificial Sequence
  Synthetic
catgtcaatgcagttcctg

SEQ ID NO: 2015 - DNA, 19 bp, Artificial Sequence
  Synthetic
catgccaatacagttcctg

SEQ ID NO: 2016 - DNA, 19 bp, Artificial Sequence
  Synthetic
aggtttgctctccgaggcg

SEQ ID NO: 2017 - DNA, 27 bp, Artificial Sequence
  Synthetic
ccgtcacgcctctgagagcaaacctca

SEQ ID NO: 2018 - DNA, 21 bp, Artificial Sequence
  Synthetic
tgaggtttgctctcagaggcg

SEQ ID NO: 2019 - DNA, 24 bp, Artificial Sequence
  Synthetic
ccgtcacgcctcggaacatctcct

SEQ ID NO: 2020 - DNA, 25 bp, Artificial Sequence
  Synthetic
tgtctccatactgttcaatgatggc

SEQ ID NO: 2021 - DNA, 25 bp, Artificial Sequence
  Synthetic
tatctgtatactggttaatgatggc

SEQ ID NO: 2022 - DNA, 25 bp, Artificial Sequence
  Synthetic
tatctccatactgtctcatgagggc

SEQ ID NO: 2023 - DNA, 17 bp, Artificial Sequence
  Synthetic
tgagtcttccactggtg

SEQ ID NO: 2024 - DNA, 17 bp, Artificial Sequence
  Synthetic
tgagcttcccactggtg

SEQ ID NO: 2025 - DNA, 17 bp, Artificial Sequence
  Synthetic
tgagtttgccactggtg

SEQ ID NO: 2026 - DNA, 27 bp, Artificial Sequence
  Synthetic
ccgtcacgcctcggaacatctccttga

SEQ ID NO: 2027 - DNA, 21 bp, Artificial Sequence
  Synthetic
tcaaggagatgttccgaggcg

SEQ ID NO: 2028 - DNA, 21 bp, Artificial Sequence
  Synthetic
ccgtcacgcctcgttcctggg

SEQ ID NO: 2029 - DNA, 23 bp, Artificial Sequence
  Synthetic
gagcaaacctcatgccaatgcac

SEQ ID NO: 2030 - DNA, 23 bp, Artificial Sequence
  Synthetic
gagcaaacctcatgtcaatgcac

SEQ ID NO: 2031 - DNA, 23 bp, Artificial Sequence
  Synthetic
gagcaaacctcatgccaatacac

SEQ ID NO: 2032 - DNA, 18 bp, Artificial Sequence
  Synthetic
tccatttccaaagggcag

SEQ ID NO: 2033 - DNA, 18 bp, Artificial Sequence
  Synthetic
tccattcccaaagggcag

SEQ ID NO: 2034 - DNA, 15 bp, Artificial Sequence
  Synthetic
cccaggaacgaggcg

SEQ ID NO: 2035 - DNA, 23 bp, Artificial Sequence
  Synthetic
ccgtcacgcctcctgtctgtgat

SEQ ID NO: 2036 - DNA, 23 bp, Artificial Sequence
  Synthetic
ccgtcacgcctcctgtctgtgat

SEQ ID NO: 2037 - DNA, 23 bp, Artificial Sequence
  Synthetic
ccgtcacgcctcctgtctgtgat

SEQ ID NO: 2038 - DNA, 22 bp, Artificial Sequence
  Synthetic
tcctgacaatgctcaatgagga

SEQ ID NO: 2039 - DNA, 22 bp, Artificial Sequence
  Synthetic
tcctgacagtgctcaatcagga

SEQ ID NO: 2040 - DNA, 16 bp, Artificial Sequence
  Synthetic
gtcccggatgtggccc

SEQ ID NO: 2041 - DNA, 19 bp, Artificial Sequence
  Synthetic
acatcacagacaggaggcg

SEQ ID NO: 2042 - DNA, 24 bp, Artificial Sequence
  Synthetic
ccgtcacgcctcctgtctgtgatg

SEQ ID NO: 2043 - DNA, 16 bp, Artificial Sequence
  Synthetic
tcccggatgtggccct

SEQ ID NO: 2044 - DNA, 18 bp, Artificial Sequence
  Synthetic
catcacagacaggaggcg

SEQ ID NO: 2045 - DNA, 25 bp, Artificial Sequence
  Synthetic
ccgtcacgcctcctgtctgtgatgt

SEQ ID NO: 2046 - DNA, 16 bp, Artificial Sequence
  Synthetic
gtcccggatgtggccc

SEQ ID NO: 2047 - DNA, 17 bp, Artificial Sequence
  Synthetic
atcacagacaggaggcg

SEQ ID NO: 2048 - DNA, 21 bp, Artificial Sequence
  Synthetic
ccgtcacgcctctggcccttc

SEQ ID NO: 2049 - DNA, 22 bp, Artificial Sequence
  Synthetic
ctgtctgtgatgtcccggatga

SEQ ID NO: 2050 - DNA, 20 bp, Artificial Sequence
  Synthetic
tcaaatgtcctgtagtgctc

SEQ ID NO: 2051 - DNA, 20 bp, Artificial Sequence
  Synthetic
tcaaaggttttgtagtgctc

SEQ ID NO: 2052 - DNA, 15 bp, Artificial Sequence
  Synthetic
gaagggccagaggcg

SEQ ID NO: 2053 - DNA, 23 bp, Artificial Sequence
  Synthetic
ccgtcacgcctctggcccttctc

SEQ ID NO: 2054 - DNA, 17 bp, Artificial Sequence
  Synthetic
gagaagggccagaggcg

SEQ ID NO: 2055 - DNA, 25 bp, Artificial Sequence
  Synthetic
ccgtcacgcctcctgtctgtgatgt

SEQ ID NO: 2056 - DNA, 22 bp, Artificial Sequence
  Synthetic
tcctgacaatgctcaatgagga

SEQ ID NO: 2057 - DNA, 22 bp, Artificial Sequence
  Synthetic
tcctgacagtgctcaatcagga

SEQ ID NO: 2058 - DNA, 15 bp, Artificial Sequence
  Synthetic
cccggatgtggccct

SEQ ID NO: 2059 - DNA, 19 bp, Artificial Sequence
  Synthetic
acatcacagacaggaggcg

SEQ ID NO: 2060 - DNA, 26 bp, Artificial Sequence
  Synthetic
aacgaggcgcacggactgttttctgc

SEQ ID NO: 2061 - DNA, 26 bp, Artificial Sequence
  Synthetic
aacgaggcgcacggactgttttctgc

SEQ ID NO: 2062 - DNA, 26 bp, Artificial Sequence
  Synthetic
aacgaggcgcacggactgttttctgc

SEQ ID NO: 2063 - DNA, 27 bp, Artificial Sequence
  Synthetic
cttgttgaagtcttgatagtgttcctc

SEQ ID NO: 2064 - DNA, 27 bp, Artificial Sequence
  Synthetic
cttgtcaaagtcctgatagtgctcctc

SEQ ID NO: 2065 - DNA, 20 bp, Artificial Sequence
  Synthetic
gcagaaaacagtccgtgcgc

SEQ ID NO: 2066 - DNA, 23 bp, Artificial Sequence
  Synthetic
aacgaggcgcacgatgtccatcg

SEQ ID NO: 2067 - DNA, 28 bp, Artificial Sequence
  Synthetic
gcaatcaataaagtcccgagggttgttc

SEQ ID NO: 2068 - DNA, 25 bp, Artificial Sequence
  Synthetic
attcttggtgttcttttactttctc

SEQ ID NO: 2069 - DNA, 17 bp, Artificial Sequence
  Synthetic
cgatggacatcgtgcgc

SEQ ID NO: 2070 - DNA, 29 bp, Artificial Sequence
  Synthetic
aacgaggcgcaccaaactcactcatggct

SEQ ID NO: 2071 - DNA, 22 bp, Artificial Sequence
  Synthetic
agccatgagtgagtttggtgcg

SEQ ID NO: 2072 - DNA, 28 bp, Artificial Sequence
  Synthetic
aacgaggcgcaccaaactcactcatggc

SEQ ID NO: 2073 - DNA, 21 bp, Artificial Sequence
  Synthetic
gccatgagtgagtttggtgcg

SEQ ID NO: 2074 - DNA, 17 bp, Artificial Sequence
  Synthetic
gccatgagtgagtttgg

SEQ ID NO: 2075 - DNA, 19 bp, Artificial Sequence
  Synthetic
gccatgagtgagtttggtg

SEQ ID NO: 2076 - DNA, 21 bp, Artificial Sequence
  Synthetic
gccatgagtgagtttggtgcg

SEQ ID NO: 2077 - DNA, 23 bp, Artificial Sequence
  Synthetic
gccatgagtgagtttggtgcgcc

SEQ ID NO: 2078 - DNA, 27 bp, Artificial Sequence
  Synthetic
aacgaggcgcaccaaactcactcatgg

SEQ ID NO: 2079 - DNA, 25 bp, Artificial Sequence
  Synthetic
ctttgtacatgccttctcttggagc

SEQ ID NO: 2080 - DNA, 20 bp, Artificial Sequence
  Synthetic
ccatgagtgagtttggtgcg

SEQ ID NO: 2081 - DNA, 26 bp, Artificial Sequence
  Synthetic
aacgaggcgcaccaaactcactcatg

SEQ ID NO: 2082 - DNA, 25 bp, Artificial Sequence
  Synthetic
gctttgtacatgccttctcttggag

SEQ ID NO: 2083 - DNA, 19 bp, Artificial Sequence
  Synthetic
catgagtgagtttggtgcg

SEQ ID NO: 2084 - DNA, 25 bp, Artificial Sequence
  Synthetic
aacgaggcgcaccaaactcactcat

SEQ ID NO: 2085 - DNA, 25 bp, Artificial Sequence
  Synthetic
ggctttgtacatgccttctcttgga

SEQ ID NO: 2086 - DNA, 26 bp, Artificial Sequence
  Synthetic
ggctttgtagatgcctttctcttgga

SEQ ID NO: 2087 - DNA, 18 bp, Artificial Sequence
  Synthetic
atgagtgagtttggtgcg

SEQ ID NO: 2088 - DNA, 25 bp, Artificial Sequence
  Synthetic
ccgtcacgcctccaaactcactcat

SEQ ID NO: 2089 - DNA, 18 bp, Artificial Sequence
  Synthetic
atgagtgagtttggaggc

SEQ ID NO: 2090 - DNA, 29 bp, Artificial Sequence
  Synthetic
taggcttctatgtagttgatgaagatgta

SEQ ID NO: 2091 - DNA, 35 bp, Artificial Sequence; identical to SEQ ID NO: 622
  Synthetic

SEQ ID NO: 2092 - DNA, 27 bp, Artificial Sequence
  Synthetic
aacgaggcgcactctcctgtgacctcg

SEQ ID NO: 2093 - DNA, 20 bp, Artificial Sequence
  Synthetic
cgaggtcacaggagagtgcg

SEQ ID NO: 2094 - DNA, 25 bp, Artificial Sequence
  Synthetic
aacgaggcgcactctcctgtgacct

SEQ ID NO: 2095 - DNA, 18 bp, Artificial Sequence
  Synthetic
aggtcacaggagagtgcg

SEQ ID NO: 2096 - DNA, 25 bp, Artificial Sequence
  Synthetic
cagtcacgtctctctcctgtgacct

SEQ ID NO: 2097 - DNA, 19 bp, Artificial Sequence
  Synthetic
aggtcacaggagagagacg

SEQ ID NO: 2098 - DNA, 18 bp, Artificial Sequence
  Synthetic
aggtcacaggagagagac

SEQ ID NO: 2099 - DNA, 26 bp, Artificial Sequence
  Synthetic
aaccagtcgtacgtctcctgtgacct

SEQ ID NO: 2100 - DNA, 18 bp, Artificial Sequence
  Synthetic
aggtcacaggagacgtac

SEQ ID NO: 2101 - DNA, 24 bp, Artificial Sequence
  Synthetic
ccagtcgtacgtctcctgtgacct

SEQ ID NO: 2102 - DNA, 18 bp, Artificial Sequence
  Synthetic
aggtcacaggagagtgcg

SEQ ID NO: 2103 - DNA, 25 bp, Artificial Sequence
  Synthetic
aaccacccgcactctcctgtgacct

SEQ ID NO: 2104 - DNA, 24 bp, Artificial Sequence
  Synthetic
aacgaggcgcactctcctgtgacc

SEQ ID NO: 2105 - DNA, 17 bp, Artificial Sequence
  Synthetic
ggtcacaggagagtgcg

SEQ ID NO: 2106 - DNA, 22 bp, Artificial Sequence
  Synthetic
aacgaggcgcactctcctgtga

SEQ ID NO: 2107 - DNA, 28 bp, Artificial Sequence
  Synthetic
cctcggttcaaaatgccgatgatctctc

SEQ ID NO: 2108 - DNA, 16 bp, Artificial Sequence
  Synthetic
tcacaggagagtgcgc

SEQ ID NO: 2109 - DNA, 26 bp, Artificial Sequence
  Synthetic
atccatctccgtgcatggcgtcccta

SEQ ID NO: 2110 - DNA, 26 bp, Artificial Sequence
  Synthetic
atccatctccgtgaatggcgtcccta

SEQ ID NO: 2111 - DNA, 27 bp, Artificial Sequence
  Synthetic
aacgaggcgcaccccttctcctgtgac

SEQ ID NO: 2112 - DNA, 20 bp, Artificial Sequence
  Synthetic
gtcacaggagaaggggtgcg

SEQ ID NO: 2113 - DNA, 24 bp, Artificial Sequence
  Synthetic
aacgaggcgcaccccttctcctgt

SEQ ID NO: 2114 - DNA, 17 bp, Artificial Sequence
  Synthetic
acaggagaaggggtgcg

SEQ ID NO: 2115 - DNA, 27 bp, Artificial Sequence
  Synthetic
ggcacatccatctccgtgcatggcgta

SEQ ID NO: 2116 - DNA, 27 bp, Artificial Sequence
  Synthetic
ccgtcacgcctcctcctgtgacctcgt

SEQ ID NO: 2117 - DNA, 20 bp, Artificial Sequence
  Synthetic
acgaggtcacaggaggaggc

SEQ ID NO: 2118 - DNA, 25 bp, Artificial Sequence
  Synthetic
ccgtcacgcctcctcctgtgacctc

SEQ ID NO: 2119 - DNA, 18 bp, Artificial Sequence
  Synthetic
gaggtcacaggaggaggc

SEQ ID NO: 2120 - DNA, 23 bp, Artificial Sequence
  Synthetic
ccgtcacgcctcctcctgtgacc

SEQ ID NO: 2121 - DNA, 29 bp, Artificial Sequence
  Synthetic
tcggttcaaaatgccgatgatctctctca

SEQ ID NO: 2122 - DNA, 17 bp, Artificial Sequence
  Synthetic
ggtcacaggaggaggcg

SEQ ID NO: 2123 - DNA, 22 bp, Artificial Sequence
  Synthetic
ccgtcacgcctcctcctgtgac

SEQ ID NO: 2124 - DNA, 30 bp, Artificial Sequence
  Synthetic
ctcggttcaaaatgccgatgatctctctca

SEQ ID NO: 2125 - DNA, 16 bp, Artificial Sequence
  Synthetic
gtcacaggaggaggcg

SEQ ID NO: 2126 - DNA, 29 bp, Artificial Sequence
  Synthetic
acatccatctccgtgcatggcgtccctta

SEQ ID NO: 2127 - DNA, 23 bp, Artificial Sequence
  Synthetic
cagtcacgtctctcccttctcct

SEQ ID NO: 2128 - DNA, 17 bp, Artificial Sequence
  Synthetic
aggagaagggagagacg

SEQ ID NO: 2129 - DNA, 25 bp, Artificial Sequence
  Synthetic
gcacatccatctccgtgcatggcga

SEQ ID NO: 2130 - DNA, 23 bp, Artificial Sequence
  Synthetic
ccgccgagatcactcctgtgacc

SEQ ID NO: 2131 - DNA, 16 bp, Artificial Sequence
  Synthetic
ggtcacaggagtgatc

SEQ ID NO: 2132 - DNA, 22 bp, Artificial Sequence
  Synthetic
ccgtcacgcctctcctgtgacc

SEQ ID NO: 2133 - DNA, 20 bp, Artificial Sequence
  Synthetic
ccgtgcatggcgtcccttca

SEQ ID NO: 2134 - DNA, 16 bp, Artificial Sequence
  Synthetic
ggtcacaggagaggcg

SEQ ID NO: 2135 - DNA, 21 bp, Artificial Sequence
  Synthetic
ccgtcacgcctccctgtgacc

SEQ ID NO: 2136 - DNA, 20 bp, Artificial Sequence
  Synthetic
cgtgcatggcgtcccttcta

SEQ ID NO: 2137 - DNA, 15 bp, Artificial Sequence
  Synthetic
ggtcacagggaggcg

SEQ ID NO: 2138 - DNA, 33 bp, Artificial Sequence
  Synthetic
cagtcacgtctcttagtttacaacagttactct

SEQ ID NO: 2139 - DNA, 29 bp, Artificial Sequence
  Synthetic
agagtaactgttgtaaaactaaagagacg

SEQ ID NO: 2140 - DNA, 26 bp, Artificial Sequence
  Synthetic
gcactcaaatgtgttgtcagagccca

SEQ ID NO: 2141 - DNA, 28 bp, Artificial Sequence
  Synthetic
cagtcacgtctctccttttgccagttcc

SEQ ID NO: 2142 - DNA, 22 bp, Artificial Sequence
  Synthetic
ggaactggcaaaaggagagacg

SEQ ID NO: 2143 - DNA, 27 bp, Artificial Sequence
  Synthetic
cagtcacgtctctccttttgccagttc

SEQ ID NO: 2144 - DNA, 21 bp, Artificial Sequence
  Synthetic
gaactggcaaaaggagagacg

SEQ ID NO: 2145 - DNA, 26 bp, Artificial Sequence
  Synthetic
cagtcacgtctctccttttgccagtt

SEQ ID NO: 2146 - DNA, 20 bp, Artificial Sequence
  Synthetic
aactggcaaaaggagagacg

SEQ ID NO: 2147 - DNA, 26 bp, Artificial Sequence
  Synthetic
gctctgcaggattttcatgtcaccaa

SEQ ID NO: 2148 - DNA, 26 bp, Artificial Sequence
  Synthetic
ccgccggagatcactctgactgcctg

SEQ ID NO: 2149 - DNA, 22 bp, Artificial Sequence
  Synthetic
caggcagtcagagtgatctcgg

SEQ ID NO: 2150 - DNA, 25 bp, Artificial Sequence
  Synthetic
ccgccggagatcactctgactgcct

SEQ ID NO: 2151 - DNA, 21 bp, Artificial Sequence
  Synthetic
aggcagtcagagtgatctcgg

SEQ ID NO: 2152 - DNA, 28 bp, Artificial Sequence
  Synthetic
cttgtcactcggggttcgagaagatgaa

SEQ ID NO: 2153 - DNA, 29 bp, Artificial Sequence
  Synthetic
gccgtcacgcctctcatctgtttagggcc

SEQ ID NO: 2154 - DNA, 23 bp, Artificial Sequence
  Synthetic
ggccctaaacagatgagaggcgt

SEQ ID NO: 2155 - DNA, 25 bp, Artificial Sequence
  Synthetic
ggccctaaacagatgagaggcgtga

SEQ ID NO: 2156 - DNA, 21 bp, Artificial Sequence
  Synthetic
caggtcctggaaggagcacta

SEQ ID NO: 2157 - DNA, 30 bp, Artificial Sequence
  Synthetic
gccgtcacgcctctctcctcattgaatcct

SEQ ID NO: 2158 - DNA, 26 bp, Artificial Sequence
  Synthetic
aggattcaatgaggagagaggcgtga

SEQ ID NO: 2159 - DNA, 24 bp, Artificial Sequence
  Synthetic
aggattcaatgaggagagaggcgt

SEQ ID NO: 2160 - DNA, 29 bp, Artificial Sequence
  Synthetic
ccgtcacgcctctctcctcattgaatcct

SEQ ID NO: 2161 - DNA, 23 bp, Artificial Sequence
  Synthetic
aggattcaatgaggagagaggcg

SEQ ID NO: 2162 - DNA, 29 bp, Artificial Sequence
  Synthetic
gccgtcacgcctctctcctcattgaatcc

SEQ ID NO: 2163 - DNA, 25 bp, Artificial Sequence
  Synthetic
ggattcaatgaggagagaggcgtga

SEQ ID NO: 2164 - DNA, 23 bp, Artificial Sequence
  Synthetic
ggattcaatgaggagagaggcgt

SEQ ID NO: 2165 - DNA, 28 bp, Artificial Sequence
  Synthetic
ccgtcacgcctctctcctcattgaatcc

SEQ ID NO: 2166 - DNA, 22 bp, Artificial Sequence
  Synthetic
ggattcaatgaggagagaggcg

SEQ ID NO: 2167 - DNA, 27 bp, Artificial Sequence
  Synthetic
ccgtcacgcctctctcctcattgaatc

SEQ ID NO: 2168 - DNA, 21 bp, Artificial Sequence
  Synthetic
gattcaatgaggagagaggcg

SEQ ID NO: 2169 - DNA, 28 bp, Artificial Sequence
  Synthetic
ccgccgagatcactctcctcattgaatc

SEQ ID NO: 2170 - DNA, 23 bp, Artificial Sequence
  Synthetic
gattcaatgaggagagtgatctc

SEQ ID NO: 2171 - DNA, 34 bp, Artificial Sequence; identical to SEQ ID NO: 807
  Synthetic

SEQ ID NO: 2172 - DNA, 29 bp, Artificial Sequence
  Synthetic
cggaggaagcagttggtgcgcctcgttaa

SEQ ID NO: 2173 - DNA, 14 bp, Artificial Sequence
  Synthetic
  misc_feature (4)..(4): The residue at this position is linked to a spacer bearing  a Cy3 dye.
caacgcttcctccg

SEQ ID NO: 2174 - DNA, 27 bp, Artificial Sequence
  Synthetic
ccaggaagcaagtggtgcgcctcgttt

SEQ ID NO: 2175 - DNA, 13 bp, Artificial Sequence
  Synthetic
  misc_feature (3)..(3): The residue at this position is linked to a Z21 quenching group.
cactgcttcgtgg

SEQ ID NO: 2176 - DNA, 28 bp, Artificial Sequence
  Synthetic
cggaagaagcagttggaggcgtgacggt

SEQ ID NO: 2177 - DNA, 14 bp, Artificial Sequence
  Synthetic
  misc_feature (4)..(4): The residue at this position is linked to a spacer bearing a Cy3 dye.
caacgcttcctccg

SEQ ID NO: 2178 - DNA, 28 bp, Artificial Sequence
  Synthetic
cggaagaagcagttggaggcgtgacggc

SEQ ID NO: 2179 - DNA, 14 bp, Artificial Sequence
  Synthetic
  misc_feature (4)..(4): The residue at this position is linked to a spacer bearing a Cy3 dye.
caacgcttcctccg

SEQ ID NO: 2180 - DNA, 27 bp, Artificial Sequence
  Synthetic
ccaggaagcaagtggaggcgtgacggu

SEQ ID NO: 2181 - DNA, 13 bp, Artificial Sequence
  Synthetic
  misc_feature (3)..(3): The residue at this position is linked to a Z21 quenching group.
cactgcttcgtgg

SEQ ID NO: 2182 - DNA, 28 bp, Artificial Sequence
  Synthetic
cggaggaagcagttggtgatctcggcgg

SEQ ID NO: 2183 - DNA, 14 bp, Artificial Sequence
  Synthetic
  misc_feature (4)..(4): The residue at this position is linked to a spacer bearing a Cy3 dye.
caacgcttcctccg

SEQ ID NO: 2184 - DNA, 28 bp, Artificial Sequence
  Synthetic
cggaagaagcagttggtgatctcggcgg

SEQ ID NO: 2185 - DNA, 14 bp, Artificial Sequence
  Synthetic
  misc_feature (4)..(4): The residue at this position is linked to a spacer bearing a Cy3 dye.
caacgcttcctccg

SEQ ID NO: 2186 - DNA, 29 bp, Artificial Sequence
  Synthetic
gctactgagatgaaggagacgtgactgta

SEQ ID NO: 2187 - DNA, 14 bp, Artificial Sequence
  Synthetic
  misc_feature (4)..(4): The residue at this position is linked to a spacer bearing a Cy3 dye.
cttctctcagtagc

SEQ ID NO: 2188 - DNA, 30 bp, Artificial Sequence
  Synthetic
ccgaggaagcggttgcgtacgactggttaa

SEQ ID NO: 2189 - DNA, 14 bp, Artificial Sequence
  Synthetic
  misc_feature (4)..(4): The residue at this position is linked to a spacer bearing a Cy3 dye.
caacgcttcctccg

SEQ ID NO: 2190 - DNA, 29 bp, Artificial Sequence
  Synthetic
cggaggaagcggttggtgcgggtggttgg

SEQ ID NO: 2191 - DNA, 14 bp, Artificial Sequence
  Synthetic
  misc_feature (4)..(4): The residue at this position is linked to a spacer bearing a Cy3 dye.
caacgcttcctccg

SEQ ID NO: 2192 - DNA, 14 bp, Artificial Sequence
  Synthetic
  misc_feature (4)..(4): The residue at this position is linked to a spacer bearing a Cy3 dye.
caacgcttcctccg

SEQ ID NO: 2193 - DNA, 12 bp, Artificial Sequence
  Synthetic
  misc_feature (4)..(4): The residue at this position is linked to a spacer bearing a Cy3 dye.
attctctcagac

SEQ ID NO: 2194 - DNA, 14 bp, Artificial Sequence
  Synthetic
  misc_feature (4)..(4): The residue at this position is linked to a spacer bearing a Cy3 dye.
taacgcttcctccg

SEQ ID NO: 2195 - DNA, 14 bp, Artificial Sequence
  Synthetic
  misc_feature (3)..(3): The residue at this position is linked to a Dabcyl quencher.
caatgcttcctccg

SEQ ID NO: 2196 - DNA, 14 bp, Artificial Sequence
  Synthetic
  misc_feature (3)..(3): The residue at this position is linked to a Z21 quenching group.
ctcttctcagtgcg

SEQ ID NO: 2197 - DNA, 13 bp, Artificial Sequence
  Synthetic
  misc_feature (3)..(3): The residue at this position is linked to a Z21 quenching group.
cactgcttcgtgg

SEQ ID NO: 2198 - DNA, 13 bp, Artificial Sequence
  Synthetic
  misc_feature (3)..(3): The residue at this position is linked to a Z28 quenching group.
cactgcttcgtgg

SEQ ID NO: 2199 - DNA, 12 bp, Artificial Sequence
  Synthetic
  misc_feature (4)..(4): The residue at this position is linked to a spacer bearing a Cy3 dye.
cttctctcagac

SEQ ID NO: 2200 - DNA, 28 bp, Artificial Sequence
  Synthetic
cggaggaagcagttggaggcgtgacggt

SEQ ID NO: 2201 - DNA, 29 bp, Artificial Sequence
  Synthetic
cggaggaagcagttgtggcggtgacggtt

SEQ ID NO: 2202 - DNA, 28 bp, Artificial Sequence
  Synthetic
cagtctgagatgaatgagacgagagagt

SEQ ID NO: 2203 - DNA, 29 bp, Artificial Sequence
  Synthetic
cggaggaagcggttagtctgtcacgtcat

SEQ ID NO: 2204 - DNA, 29 bp, Artificial Sequence
  Synthetic
cggaggaagcggttagtctgccacgtcat

SEQ ID NO: 2205 - DNA, 29 bp, Artificial Sequence
  Synthetic
cggaagaagcagttggtgcgcctcgttaa

SEQ ID NO: 2206 - DNA, 29 bp, Artificial Sequence
  Synthetic
cggaggaagcagttggtgcgcctcgttaa

SEQ ID NO: 2207 - DNA, 27 bp, Artificial Sequence
  Synthetic
cggaggaagcagttgcggcgtgcggct

SEQ ID NO: 2208 - DNA, 29 bp, Artificial Sequence
  Synthetic
gcgcagtgagaatgaggaggcgtgacggu

SEQ ID NO: 2209 - DNA, 27 bp, Artificial Sequence
  Synthetic
ccaggaagcaagtggtgcgcctcguuu

SEQ ID NO: 2210 - DNA, 26 bp, Artificial Sequence
  Synthetic
cagtctgagatgaatgatacgccagg

SEQ ID NO: 2211 - DNA, 29 bp, Artificial Sequence
  Synthetic
agtctgagatgaaggagacgtgactgtgg

SEQ ID NO: 2212 - DNA, 27 bp, Artificial Sequence
  Synthetic
cggaggaagcggttggtgatctcggcg

SEQ ID NO: 2213 - DNA, 29 bp, Artificial Sequence
  Synthetic
tctgtggcgtatccttcttgggcatgtaa

SEQ ID NO: 2214 - DNA, 26 bp, Artificial Sequence
  Synthetic
gtggcgtatccttcttgggcatgtaa

SEQ ID NO: 2215 - DNA, 23 bp, Artificial Sequence
  Synthetic
gcgtatccttcttgggcatgtaa

SEQ ID NO: 2216 - DNA, 22 bp, Artificial Sequence
  Synthetic
  modified_base (22)..(22): The modified nucleotide at this position is a dideoxy cytosine.
gaagatgtttcagttctgtggc

SEQ ID NO: 2217 - DNA, 25 bp, Artificial Sequence
  Synthetic
  modified_base (23)..(23): The modified nucleotide at this position is biotinylated deoxyade nosine.
aaaagatacgccacagaacacgatt

SEQ ID NO: 2218 - DNA, 26 bp, Artificial Sequence
  Synthetic
tggcgtatcttaattccattcaaaat

SEQ ID NO: 2219 - DNA, 26 bp, Artificial Sequence
  Synthetic
tgggagtttgggattcttgtaattaa

SEQ ID NO: 2220 - DNA, 19 bp, Artificial Sequence
  Synthetic
  modified_base (18)..(18): The modified nucleotide at this position is biotinylated deoxythy midine.
aaaagatacgccacagctc

SEQ ID NO: 2221 - DNA, 27 bp, Artificial Sequence
  Synthetic
tggcgtatctaattattaattccattc

SEQ ID NO: 2222 - DNA, 25 bp, Artificial Sequence
  Synthetic
atcctggtgagtttgggattcttga

SEQ ID NO: 2223 - DNA, 19 bp, Artificial Sequence
  Synthetic
  modified_base (18)..(18): The modified nucleotide at this position is biotinylated deoxythy midine.
aaaagatacgccacagctc

SEQ ID NO: 2224 - DNA, 26 bp, Artificial Sequence
  Synthetic
tggcgtatcttccattcaaaatcatc

SEQ ID NO: 2225 - DNA, 25 bp, Artificial Sequence
  Synthetic
gtttgggattcttgtaattattaaa

SEQ ID NO: 2226 - DNA, 19 bp, Artificial Sequence
  Synthetic
  modified_base (18)..(18): The modified nucleotide at this position is biotinylated deoxythy midine.
aaaagatacgccacagctc

SEQ ID NO: 2227 - DNA, 22 bp, Artificial Sequence
  Synthetic
gtggcgtatccttcttgggcat

SEQ ID NO: 2228 - DNA, 22 bp, Artificial Sequence
  Synthetic
gaagatgtttcagttctgtggc

SEQ ID NO: 2229 - DNA, 19 bp, Artificial Sequence
  Synthetic
  modified_base (18)..(18): The modified nucleotide at this position is biotinylated deoxythy midine.
aaaagatacgccacagctc

SEQ ID NO: 2230 - DNA, 23 bp, Artificial Sequence
  Synthetic
tggcgtatctctgggtcatcttc

SEQ ID NO: 2231 - DNA, 25 bp, Artificial Sequence
  Synthetic
gggtgttgaaggtctcaaacatgaa

SEQ ID NO: 2232 - DNA, 19 bp, Artificial Sequence
  Synthetic
  modified_base (18)..(18): The modified nucleotide at this position is biotinylated deoxythy midine.
aaaagatacgccacagctc

SEQ ID NO: 2233 - DNA, 25 bp, Artificial Sequence
  Synthetic
tggcgtatctcttgatcttcattgt

SEQ ID NO: 2234 - DNA, 25 bp, Artificial Sequence
  Synthetic
acttgcgctcaggaggagcaatgaa

SEQ ID NO: 2235 - DNA, 19 bp, Artificial Sequence
  Synthetic
  modified_base (18)..(18): The modified nucleotide at this position is biotinylated deoxythy midine.
aaaagatacgccacagctc

SEQ ID NO: 2236 - DNA, 24 bp, Artificial Sequence
  Synthetic
tggcgtatctgatctgggtcatct

SEQ ID NO: 2237 - DNA, 28 bp, Artificial Sequence
  Synthetic
tggctggggtgttgaaggtctcaaacaa

SEQ ID NO: 2238 - DNA, 19 bp, Artificial Sequence
  Synthetic
  modified_base (18)..(18): The modified nucleotide at this position is biotinylated deoxythy midine.
aaaagatacgccacagctc

SEQ ID NO: 2239 - DNA, 22 bp, Artificial Sequence
  Synthetic
acccgtatctgcccaggaagga

SEQ ID NO: 2240 - DNA, 27 bp, Artificial Sequence
  Synthetic
agtttcgtggatgccacaggagaccaa

SEQ ID NO: 2241 - DNA, 27 bp, Artificial Sequence
  Synthetic
agtttcgtggatgctacaggagaccaa

SEQ ID NO: 2242 - DNA, 19 bp, Artificial Sequence
  Synthetic
aaaagatacgccacagctc

SEQ ID NO: 2243 - DNA, 24 bp, Artificial Sequence
  Synthetic
tggcgtatctctcaaacatgatct

SEQ ID NO: 2244 - DNA, 26 bp, Artificial Sequence
  Synthetic
acgtacatggctggggtgttgaagga

SEQ ID NO: 2245 - DNA, 19 bp, Artificial Sequence
  Synthetic
  modified_base (18)..(18): The modified nucleotide at this position is biotinylated deoxythy midine.
aaaagatacgccacagctc

SEQ ID NO: 2246 - DNA, 23 bp, Artificial Sequence
  Synthetic
tggcgtatctgatctgggtcatc

SEQ ID NO: 2247 - DNA, 28 bp, Artificial Sequence
  Synthetic
tggctggggtgttgaaggtctcaaacaa

SEQ ID NO: 2248 - DNA, 19 bp, Artificial Sequence
  Synthetic
  modified_base (18)..(18): The modified nucleotide at this position is biotinylated deoxythy midine.
aaaagatacgccacagctc

SEQ ID NO: 2249 - DNA, 24 bp, Artificial Sequence
  Synthetic
ccgtcacgcctcgccttggggttc

SEQ ID NO: 2250 - DNA, 24 bp, Artificial Sequence
  Synthetic
tctgggtcatcttctcgcggttga

SEQ ID NO: 2251 - DNA, 19 bp, Artificial Sequence
  Synthetic
gaaccccaaggcgaggcgt

SEQ ID NO: 2252 - DNA, 25 bp, Artificial Sequence
  Synthetic
ccgtcaccgccatgggtcatcttct

SEQ ID NO: 2253 - DNA, 19 bp, Artificial Sequence
  Synthetic
cgcggttggccttggggtt

SEQ ID NO: 2254 - DNA, 30 bp, Artificial Sequence
  Synthetic
ctggggtgttgaaggtctcaaacatgatcc

SEQ ID NO: 2255 - DNA, 19 bp, Artificial Sequence
  Synthetic
agaagatgacccatggcgg

SEQ ID NO: 2256 - DNA, 22 bp, Artificial Sequence
  Synthetic
ctctctcgtctctcctggaaga

SEQ ID NO: 2257 - DNA, 24 bp, Artificial Sequence
  Synthetic
atttgatgttagtggggtctcgca

SEQ ID NO: 2258 - DNA, 23 bp, Artificial Sequence
  Synthetic
ctctctcgtctctgctgacaatc

SEQ ID NO: 2259 - DNA, 24 bp, Artificial Sequence
  Synthetic
gcagttggtggtgcaggatgcata

SEQ ID NO: 2260 - DNA, 24 bp, Artificial Sequence
  Synthetic
ctctctcgtctctaccaggaaatg

SEQ ID NO: 2261 - DNA, 23 bp, Artificial Sequence
  Synthetic
gctgtagccgtattcattgtcaa

SEQ ID NO: 2262 - DNA, 22 bp, Artificial Sequence
  Synthetic
ctctctcgtctcctcctggaag

SEQ ID NO: 2263 - DNA, 24 bp, Artificial Sequence
  Synthetic
catttgatgttagtggggtctcga

SEQ ID NO: 2264 - DNA, 22 bp, Artificial Sequence
  Synthetic
ctctctcgtctctcctggaaga

SEQ ID NO: 2265 - DNA, 24 bp, Artificial Sequence
  Synthetic
atttgatgttagtggggtctcgca

SEQ ID NO: 2266 - DNA, 16 bp, Artificial Sequence
  Synthetic
tcttccaggagagacg

SEQ ID NO: 2267 - DNA, 22 bp, Artificial Sequence
  Synthetic
ctctctcgtctcctcctggaag

SEQ ID NO: 2268 - DNA, 24 bp, Artificial Sequence
  Synthetic
catttgatgttagtggggtctcga

SEQ ID NO: 2269 - DNA, 16 bp, Artificial Sequence
  Synthetic
cttccaggaggagacg

SEQ ID NO: 2270 - DNA, 24 bp, Artificial Sequence
  Synthetic
ctctctcgtctctaccaggaaatg

SEQ ID NO: 2271 - DNA, 23 bp, Artificial Sequence
  Synthetic
gctgtagccgtattcattgtcaa

SEQ ID NO: 2272 - DNA, 18 bp, Artificial Sequence
  Synthetic
catttcctggtagagacg

SEQ ID NO: 2273 - DNA, 26 bp, Artificial Sequence
  Synthetic
atgacgtgacagacctcctggaagat

SEQ ID NO: 2274 - DNA, 27 bp, Artificial Sequence
  Synthetic
atgacgtgacagacctcctggaagatg

SEQ ID NO: 2275 - DNA, 24 bp, Artificial Sequence
  Synthetic
catttgatgttagtggggtctcga

SEQ ID NO: 2276 - DNA, 19 bp, Artificial Sequence
  Synthetic
catcttccaggaggtctgt

SEQ ID NO: 2277 - DNA, 26 bp, Artificial Sequence
  Synthetic
atgacgtggcagacctcctggaagat

SEQ ID NO: 2278 - DNA, 24 bp, Artificial Sequence
  Synthetic
catttgatgttagtggggtctcga

SEQ ID NO: 2279 - DNA, 18 bp, Artificial Sequence
  Synthetic
atcttccaggaggtctgc

SEQ ID NO: 2280 - DNA, 23 bp, Artificial Sequence
  Synthetic
cagtcacgtctcttcaggttttg

SEQ ID NO: 2281 - DNA, 24 bp, Artificial Sequence
  Synthetic
aggcagctctcaggtcaggtgtga

SEQ ID NO: 2282 - DNA, 15 bp, Artificial Sequence
  Synthetic
  misc_feature (4)..(4): The residue at this position is linked to a spacer bearing a Cy3 dye.
cttctctcagtagcg

SEQ ID NO: 2283 - DNA, 30 bp, Artificial Sequence
  Synthetic
cgctactgagatgaaggagacgtgactgta

SEQ ID NO: 2284 - DNA, 30 bp, Artificial Sequence
  Synthetic
cgctaatgagatgaaggagacgtgactgta

SEQ ID NO: 2285 - DNA, 23 bp, Artificial Sequence
  Synthetic
cagtcacgtctcttcaggttttg

SEQ ID NO: 2286 - DNA, 24 bp, Artificial Sequence
  Synthetic
aggcagctctcaggtcaggtgtga

SEQ ID NO: 2287 - DNA, 16 bp, Artificial Sequence
  Synthetic
  misc_feature (4)..(4): The residue at this position is linked to a spacer bearing a Cy3 dye.
cttctctcagtagcga

SEQ ID NO: 2288 - DNA, 31 bp, Artificial Sequence
  Synthetic
tcgctactgagatgaaggagacgtgactgta

SEQ ID NO: 2289 - DNA, 31 bp, Artificial Sequence
  Synthetic
tcgctaatgagatgaaggagacgtgactgta

SEQ ID NO: 2290 - DNA, 34 bp, Artificial Sequence
  Synthetic
aacgaggcgcacctttacattttctatcgtatcc

SEQ ID NO: 2291 - DNA, 24 bp, Artificial Sequence
  Synthetic
ccttccttatcctggatcttggca

SEQ ID NO: 2292 - DNA, 28 bp, Artificial Sequence
  Synthetic
ggatacgatagaaaatgtaaaggtgcgc

SEQ ID NO: 2293 - DNA, 33 bp, Artificial Sequence
  Synthetic
aacgaggcgcacctttacattttctatcgtatc

SEQ ID NO: 2294 - DNA, 24 bp, Artificial Sequence
  Synthetic
ccttccttatcctggatcttggca

SEQ ID NO: 2295 - DNA, 27 bp, Artificial Sequence
  Synthetic
gatacgatagaaaatgtaaaggtgcgc

SEQ ID NO: 2296 - DNA, 29 bp, Artificial Sequence
  Synthetic
aacgaggcgcacctttacattttctatcg

SEQ ID NO: 2297 - DNA, 30 bp, Artificial Sequence
  Synthetic
aacgaggcgcacctttacattttctatcgt

SEQ ID NO: 2298 - DNA, 24 bp, Artificial Sequence
  Synthetic
ccttccttatcctggatcttggca

SEQ ID NO: 2299 - DNA, 24 bp, Artificial Sequence
  Synthetic
acgatagaaaatgtaaaggtgcgc

SEQ ID NO: 2300 - DNA, 30 bp, Artificial Sequence; identical to SEQ ID NO: 2297
  Synthetic

SEQ ID NO: 2301 - DNA, 31 bp, Artificial Sequence
  Synthetic
aacgaggcgcacctttacattttctatcgtu

SEQ ID NO: 2302 - DNA, 31 bp, Artificial Sequence
  Synthetic
aacgaggcgcacctttacattttctatcgtg

SEQ ID NO: 2303 - DNA, 31 bp, Artificial Sequence
  Synthetic
aacgaggcgcacctttacattttctatcgtt

SEQ ID NO: 2304 - DNA, 24 bp, Artificial Sequence
  Synthetic
ccttccttatcctggatcttggca

SEQ ID NO: 2305 - DNA, 24 bp, Artificial Sequence
  Synthetic
acgatagaaaatgtaaaggtgcgc

SEQ ID NO: 2306 - DNA, 29 bp, Artificial Sequence
  Synthetic
gccgcacgccgctttacattttctatcgt

SEQ ID NO: 2307 - DNA, 24 bp, Artificial Sequence
  Synthetic
ccttccttatcctggatcttggca

SEQ ID NO: 2308 - DNA, 23 bp, Artificial Sequence
  Synthetic
acgatagaaaatgtaaagcggcg

SEQ ID NO: 2309 - DNA, 24 bp, Artificial Sequence
  Synthetic
acgatagaaaatgtaaagcggcgt

SEQ ID NO: 2310 - DNA, 35 bp, Artificial Sequence
  Synthetic
aacgaggcgcacctttacattttctatcgtatccg

SEQ ID NO: 2311 - DNA, 24 bp, Artificial Sequence
  Synthetic
ccttccttatcctggatcttggca

SEQ ID NO: 2312 - DNA, 29 bp, Artificial Sequence
  Synthetic
cggatacgatagaaaatgtaaaggtgcgc

SEQ ID NO: 2313 - DNA, 26 bp, Artificial Sequence
  Synthetic
ccgtcacgcctccttcggagtttggg

SEQ ID NO: 2314 - DNA, 25 bp, Artificial Sequence
  Synthetic
gggttgtggagtgagtgttcaagta

SEQ ID NO: 2315 - DNA, 20 bp, Artificial Sequence
  Synthetic
cccaaactccgaaggaggcg

SEQ ID NO: 2316 - DNA, 18 bp, Artificial Sequence
  Synthetic
ttttctggaagctttgct

SEQ ID NO: 2317 - DNA, 27 bp, Artificial Sequence
  Synthetic
cgatgccaaagaccagctgcaaggaag

SEQ ID NO: 2318 - DNA, 22 bp, Artificial Sequence
  Synthetic
gaagatcacaggaaagaaatac

SEQ ID NO: 2319 - DNA, 14 bp, Artificial Sequence
  Synthetic
gcagcttcttggga

SEQ ID NO: 2320 - DNA, 21 bp, Artificial Sequence
  Synthetic
aacgaggcgcacgttgggtga

SEQ ID NO: 2321 - DNA, 16 bp, Artificial Sequence
  Synthetic
gcagcttcttgggact

SEQ ID NO: 2322 - DNA, 22 bp, Artificial Sequence
  Synthetic
aacgaggcgcacgttgggtgag

SEQ ID NO: 2323 - DNA, 27 bp, Artificial Sequence
  Synthetic
ctccaggtagttttcctgcacgaaatc

SEQ ID NO: 2324 - DNA, 16 bp, Artificial Sequence
  Synthetic
ctcacccaacgtgcgc

SEQ ID NO: 2325 - DNA, 14 bp, Artificial Sequence
  Synthetic
agcttcttgggatc

SEQ ID NO: 2326 - DNA, 22 bp, Artificial Sequence
  Synthetic
aacgaggcgcacttgggtgagc

SEQ ID NO: 2327 - DNA, 14 bp, Artificial Sequence
  Synthetic
gcttcttgggatcc

SEQ ID NO: 2328 - DNA, 23 bp, Artificial Sequence
  Synthetic
aacgaggcgcacttgggtgagca

SEQ ID NO: 2329 - DNA, 25 bp, Artificial Sequence
  Synthetic
caggtagttttcctgcacgaaatga

SEQ ID NO: 2330 - DNA, 17 bp, Artificial Sequence
  Synthetic
tgctcacccaagtgcgc

SEQ ID NO: 2331 - DNA, 15 bp, Artificial Sequence
  Synthetic
tgcaggatcactgcc

SEQ ID NO: 2332 - DNA, 27 bp, Artificial Sequence
  Synthetic
aacgaggcgcaccaccaattcataaca

SEQ ID NO: 2333 - DNA, 16 bp, Artificial Sequence
  Synthetic
ggcccttggaccccaa

SEQ ID NO: 2334 - DNA, 21 bp, Artificial Sequence
  Synthetic
tgttatgaattggtggtgcgc

SEQ ID NO: 2335 - DNA, 16 bp, Artificial Sequence
  Synthetic
catgcaggatcactgc

SEQ ID NO: 2336 - DNA, 27 bp, Artificial Sequence
  Synthetic
aacgaggcgcaccacaccaattcataa

SEQ ID NO: 2337 - DNA, 16 bp, Artificial Sequence
  Synthetic
agggcccttggaccca

SEQ ID NO: 2338 - DNA, 21 bp, Artificial Sequence
  Synthetic
ttatgaattggtgtggtgcgc

SEQ ID NO: 2339 - DNA, 21 bp, Artificial Sequence
  Synthetic
cctggcgtatctagggctcca

SEQ ID NO: 2340 - DNA, 25 bp, Artificial Sequence
  Synthetic
gtgttcaggttttggaggcggataa

SEQ ID NO: 2341 - DNA, 17 bp, Artificial Sequence
  Synthetic
cttggagccctagatac

SEQ ID NO: 2342 - DNA, 18 bp, Artificial Sequence
  Synthetic
cttggagccctagatacg

SEQ ID NO: 2343 - DNA, 19 bp, Artificial Sequence
  Synthetic
cttggagccctagatacgc

SEQ ID NO: 2344 - DNA, 23 bp, Artificial Sequence
  Synthetic
cagtcacgtctcttcaggttttg

SEQ ID NO: 2345 - DNA, 24 bp, Artificial Sequence
  Synthetic
aggcagctctcaggtcaggtgtga

SEQ ID NO: 2346 - DNA, 20 bp, Artificial Sequence
  Synthetic
gaggcggatatagggctcca

SEQ ID NO: 2347 - DNA, 17 bp, Artificial Sequence
  Synthetic
caaaacctgaagagacg

SEQ ID NO: 2348 - DNA, 22 bp, Artificial Sequence
  Synthetic
aacgaggcgcaccctctgtgtg

SEQ ID NO: 2349 - DNA, 16 bp, Artificial Sequence
  Synthetic
cacacagagggtgcgc

SEQ ID NO: 2350 - DNA, 22 bp, Artificial Sequence
  Synthetic
aacgaggcgcaccctctgtgtg

SEQ ID NO: 2351 - DNA, 22 bp, Artificial Sequence
  Synthetic
aacgaggcgcaccctctgtgtg

SEQ ID NO: 2352 - DNA, 24 bp, Artificial Sequence
  Synthetic
gcaaggaccagactgagcagcgta

SEQ ID NO: 2353 - DNA, 15 bp, Artificial Sequence
  Synthetic
agcagtacccccatg

SEQ ID NO: 2354 - DNA, 16 bp, Artificial Sequence
  Synthetic
cacacagagggaggcg

SEQ ID NO: 2355 - DNA, 21 bp, Artificial Sequence
  Synthetic
aacgaggcgcaccttctggag

SEQ ID NO: 2356 - DNA, 12 bp, Artificial Sequence
  Synthetic
ctggccaaggag

SEQ ID NO: 2357 - DNA, 22 bp, Artificial Sequence
  Synthetic
gtcctgcatgagatctgtctga

SEQ ID NO: 2358 - DNA, 15 bp, Artificial Sequence
  Synthetic
ctccagaaggtgcgc

SEQ ID NO: 2359 - DNA, 21 bp, Artificial Sequence
  Synthetic
aacgaggcgcactctgcttct

SEQ ID NO: 2360 - DNA, 12 bp, Artificial Sequence
  Synthetic
ggagctggccaa

SEQ ID NO: 2361 - DNA, 22 bp, Artificial Sequence
  Synthetic
tggtgtcctgcatgagatctga

SEQ ID NO: 2362 - DNA, 18 bp, Artificial Sequence
  Synthetic
tccagaagcagagtgcgc

SEQ ID NO: 2363 - DNA, 22 bp, Artificial Sequence
  Synthetic
aacgaggcgcaccatgagatct

SEQ ID NO: 2364 - DNA, 13 bp, Artificial Sequence
  Synthetic
gtctgcttctgga

SEQ ID NO: 2365 - DNA, 20 bp, Artificial Sequence
  Synthetic
gagtctgctggtgtccctga

SEQ ID NO: 2366 - DNA, 16 bp, Artificial Sequence
  Synthetic
agatctcatggtgcgc

SEQ ID NO: 2367 - DNA, 13 bp, Artificial Sequence
  Synthetic
tggccaaggagca

SEQ ID NO: 2368 - DNA, 21 bp, Artificial Sequence
  Synthetic
aacgaggcgcacttctggagc

SEQ ID NO: 2369 - DNA, 22 bp, Artificial Sequence
  Synthetic
tcctgcatgagatctgtctgca

SEQ ID NO: 2370 - DNA, 15 bp, Artificial Sequence
  Synthetic
gctccagaagtgcgc

SEQ ID NO: 2371 - DNA, 13 bp, Artificial Sequence
  Synthetic
ggccaaggagcac

SEQ ID NO: 2372 - DNA, 21 bp, Artificial Sequence
  Synthetic
aacgaggcgcactctggagct

SEQ ID NO: 2373 - DNA, 22 bp, Artificial Sequence
  Synthetic
cctgcatgagatctgtctgcta

SEQ ID NO: 2374 - DNA, 15 bp, Artificial Sequence
  Synthetic
agctccagagtgcgc

SEQ ID NO: 2375 - DNA, 13 bp, Artificial Sequence
  Synthetic
gccaaggagcacg

SEQ ID NO: 2376 - DNA, 21 bp, Artificial Sequence
  Synthetic
aacgaggcgcacctggagctc

SEQ ID NO: 2377 - DNA, 23 bp, Artificial Sequence
  Synthetic
cctgcatgagatctgtctgctta

SEQ ID NO: 2378 - DNA, 15 bp, Artificial Sequence
  Synthetic
gagctccaggtgcgc

SEQ ID NO: 2379 - DNA, 26 bp, Artificial Sequence
  Synthetic
cgccgagatcacgccaacgacggtct

SEQ ID NO: 2380 - DNA, 32 bp, Artificial Sequence
  Synthetic
agcccttgagtttaataacttcataggcacta

SEQ ID NO: 2381 - DNA, 20 bp, Artificial Sequence
  Synthetic
agaccgtcgttggcgtgatc

SEQ ID NO: 2382 - DNA, 31 bp, Artificial Sequence
  Synthetic
cgccgagatcacctcaacaccataaaagcca

SEQ ID NO: 2383 - DNA, 28 bp, Artificial Sequence
  Synthetic
cgggagactgaggaatacgtcaccacca

SEQ ID NO: 2384 - DNA, 25 bp, Artificial Sequence
  Synthetic
tggcttttatggtgttgaggtgatc

SEQ ID NO: 2385 - DNA, 25 bp, Artificial Sequence
  Synthetic
ccgtcacgcctccgaactgccctag

SEQ ID NO: 2386 - DNA, 28 bp, Artificial Sequence
  Synthetic
gtataatagtcccgacgatcaaagaggc

SEQ ID NO: 2387 - DNA, 15 bp, Artificial Sequence
  Synthetic
ggtccttgggyaggg

SEQ ID NO: 2388 - DNA, 19 bp, Artificial Sequence
  Synthetic
gcggaggcttgacgggatc

SEQ ID NO: 2389 - DNA, 26 bp, Artificial Sequence
  Synthetic
ctctctcgtctccagggcgtcgtcgg

SEQ ID NO: 2390 - DNA, 22 bp, Artificial Sequence
  Synthetic
ctgtcacacacgtcggtgctga

SEQ ID NO: 2391 - DNA, 20 bp, Artificial Sequence
  Synthetic
aaaaaggagacgagagagtg

SEQ ID NO: 2392 - DNA, 13 bp, Artificial Sequence
  Synthetic
  misc_feature (4)..(4): The residue at this position is linked to a spacer bearing a Cy3 dye.
attctctcagact

SEQ ID NO: 2393 - DNA, 14 bp, Artificial Sequence
  Synthetic
  misc_feature (4)..(4): The residue at this position is linked to a spacer bearing a Cy3 dye.
caacgcttcctccg

SEQ ID NO: 2394 - DNA, 14 bp, Artificial Sequence
  Synthetic
  misc_feature (4)..(4): The residue at this position is linked to a spacer bearing a Cy3 dye.
cgcttctcgctcgc

SEQ ID NO: 2395 - DNA, 28 bp, Artificial Sequence
  Synthetic
cagtctgagatgaatgatacgagagagt

SEQ ID NO: 2396 - DNA, 28 bp, Artificial Sequence
  Synthetic
cagtctgagatgaatgagacgagagagt

SEQ ID NO: 2397 - DNA, 28 bp, Artificial Sequence
  Synthetic
cggaggaagcagttggaggcgtgacggt

SEQ ID NO: 2398 - DNA, 29 bp, Artificial Sequence
  Synthetic
cggaggaagcagttggtgcgcctcgttaa

SEQ ID NO: 2399 - DNA, 29 bp, Artificial Sequence
  Synthetic
gcggaagaagcggttggtgatctcggcgg

SEQ ID NO: 2400 - DNA, 28 bp, Artificial Sequence
  Synthetic
cggaagaagcagttggaggcgtgacggt

SEQ ID NO: 2401 - DNA, 29 bp, Artificial Sequence
  Synthetic
cggaagaagcagttggtgcgcctcgttaa

SEQ ID NO: 2402 - DNA, 29 bp, Artificial Sequence
  Synthetic
gcgagagagacagcgcaaacctgccgttc

SEQ ID NO: 2403 - DNA, 27 bp, Artificial Sequence
  Synthetic
cggaggaagcagttgtccgcgaagatg

SEQ ID NO: 2404 - DNA, 30 bp, Artificial Sequence; identical to SEQ ID NO: 1841
  Synthetic

SEQ ID NO: 2405 - DNA, 29 bp, Artificial Sequence
  Synthetic
ggagtgagacagcgaaagactgccgttct

SEQ ID NO: 2406 - DNA, 24 bp, Artificial Sequence
  Synthetic
ccgccatctagggttatgatgcta

SEQ ID NO: 2407 - DNA, 28 bp, Artificial Sequence
  Synthetic
ctctctcgtctccttcaccttcctgtcg

SEQ ID NO: 2408 - DNA, 23 bp, Artificial Sequence
  Synthetic
cgacaggaaggtgaaggagacga

SEQ ID NO: 2409 - DNA, 23 bp, Artificial Sequence
  Synthetic
cgacaggaaggtgaaggagacga

SEQ ID NO: 2410 - DNA, 25 bp, Artificial Sequence
  Synthetic
cgacaggaaggtgaaggagacgaga

SEQ ID NO: 2411 - DNA, 28 bp, Artificial Sequence
  Synthetic
aacgaggcgcaccttcaccttcctgtcg

SEQ ID NO: 2412 - DNA, 28 bp, Artificial Sequence
  Synthetic
aacgaggcgcaccttcaccttcctgtcg

SEQ ID NO: 2413 - DNA, 23 bp, Artificial Sequence
  Synthetic
cgacaggaaggtgaaggtgcgcc

SEQ ID NO: 2414 - DNA, 25 bp, Artificial Sequence
  Synthetic
cgacaggaaggtgaaggtgcgcctc

SEQ ID NO: 2415 - DNA, 28 bp, Artificial Sequence
  Synthetic
catcttcgcggacttcaccttcctgtcg

SEQ ID NO: 2416 - DNA, 20 bp, Artificial Sequence
  Synthetic
cgacaggaaggtgaagtccg

SEQ ID NO: 2417 - DNA, 22 bp, Artificial Sequence
  Synthetic
cgacaggaaggtgaagtccgcg

SEQ ID NO: 2418 - DNA, 29 bp, Artificial Sequence
  Synthetic
cttgctccccgtgcttcaccttcctgtcg

SEQ ID NO: 2419 - DNA, 29 bp, Artificial Sequence
  Synthetic
cttgctccccgtgcttcaccttcctgtcg

SEQ ID NO: 2420 - DNA, 22 bp, Artificial Sequence
  Synthetic
cgacaggaaggtgaagcacggg

SEQ ID NO: 2421 - DNA, 24 bp, Artificial Sequence
  Synthetic
cgacaggaaggtgaagcacgggga

SEQ ID NO: 2422 - DNA, 28 bp, Artificial Sequence
  Synthetic
ctctctcgtctccacattccaccaccag

SEQ ID NO: 2423 - DNA, 25 bp, Artificial Sequence
  Synthetic
ttgtgtaagtcacgcctttcataat

SEQ ID NO: 2424 - DNA, 31 bp, Artificial Sequence
  Synthetic
aacgaggcgcacgaagcagggtaatgaatct

SEQ ID NO: 2425 - DNA, 23 bp, Artificial Sequence
  Synthetic
ccactcctgaaggctccgcagtc

SEQ ID NO: 2426 - DNA, 25 bp, Artificial Sequence
  Synthetic
ctctctcgtctcaatgcctgtcgcc

SEQ ID NO: 2427 - DNA, 26 bp, Artificial Sequence
  Synthetic
gcttcagggtttgtcggaagaagaac

SEQ ID NO: 2428 - DNA, 28 bp, Artificial Sequence
  Synthetic
ctctctcgtctcgtttgcggcgatacat

SEQ ID NO: 2429 - DNA, 24 bp, Artificial Sequence
  Synthetic
cggcttgatctcttcacggtccac

SEQ ID NO: 2430 - DNA, 35 bp, Artificial Sequence
  Synthetic
ctctctcgtctcaacttcaaataccactgtaatct

SEQ ID NO: 2431 - DNA, 31 bp, Artificial Sequence
  Synthetic
ctcacgtaatttgtagcccaccaggagtttc

SEQ ID NO: 2432 - DNA, 29 bp, Artificial Sequence
  Synthetic
agattacagtggtatttgaagttgagacg

SEQ ID NO: 2433 - DNA, 29 bp, Artificial Sequence
  Synthetic
tggtccaagaccgacagcaaaatcttgag

SEQ ID NO: 2434 - DNA, 28 bp, Artificial Sequence
  Synthetic
cagtcacgtctcttcagggagtagcgca

SEQ ID NO: 2435 - DNA, 23 bp, Artificial Sequence
  Synthetic
cccgtggtaggagagcagcacta

SEQ ID NO: 2436 - DNA, 22 bp, Artificial Sequence
  Synthetic
tgcgctactccctgaagagacg

SEQ ID NO: 2437 - DNA, 25 bp, Artificial Sequence
  Synthetic
ctctctcgtctcgcccaccaggatt

SEQ ID NO: 2438 - DNA, 29 bp, Artificial Sequence
  Synthetic
ctcccaccagtcgctcacgtaatttgtaa

SEQ ID NO: 2439 - DNA, 19 bp, Artificial Sequence
  Synthetic
aatcctggtgggcgagacg

SEQ ID NO: 2440 - DNA, 38 bp, Artificial Sequence
  Synthetic
ttaacttcaaataccactgtaatcttggtccaagaccg

SEQ ID NO: 2441 - DNA, 27 bp, Artificial Sequence
  Synthetic
accgaggcgcaccaattattcctaacg

SEQ ID NO: 2442 - DNA, 29 bp, Artificial Sequence
  Synthetic
gccgtttccagagtccgattgatttttga

SEQ ID NO: 2443 - DNA, 21 bp, Artificial Sequence
  Synthetic
cgttaggaataattggtggcg

SEQ ID NO: 2444 - DNA, 33 bp, Artificial Sequence
  Synthetic
catcttcgcggagacatttcttgatgattcctt

SEQ ID NO: 2445 - DNA, 21 bp, Artificial Sequence
  Synthetic
aaaggtgtctgggctcgtgct

SEQ ID NO: 2446 - DNA, 25 bp, Artificial Sequence
  Synthetic
aaggaatcatcaagaaatgtctccg

SEQ ID NO: 2447 - DNA, 26 bp, Artificial Sequence
  Synthetic
aacgaggcgcaccagtttcctctgtg

SEQ ID NO: 2448 - DNA, 25 bp, Artificial Sequence
  Synthetic
gaccagccctgacatgaacttttac

SEQ ID NO: 2449 - DNA, 20 bp, Artificial Sequence
  Synthetic
cacagaggaaactggtgcgc

SEQ ID NO: 2450 - DNA, 30 bp, Artificial Sequence
  Synthetic
ctctctcgtctcgggagggtaataataagg

SEQ ID NO: 2451 - DNA, 27 bp, Artificial Sequence
  Synthetic
gctgccttttcaataatcttatcgaac

SEQ ID NO: 2452 - DNA, 25 bp, Artificial Sequence
  Synthetic
ccttattattaccctcccgagacga

SEQ ID NO: 2453 - DNA, 31 bp, Artificial Sequence
  Synthetic
ctctctcgtctcgttgtattctttaagccag

SEQ ID NO: 2454 - DNA, 21 bp, Artificial Sequence
  Synthetic
cggtccaggtcatccccagac

SEQ ID NO: 2455 - DNA, 26 bp, Artificial Sequence
  Synthetic
ctggcttaaagaatacaacgagacga

SEQ ID NO: 2456 - DNA, 30 bp, Artificial Sequence
  Synthetic
ctctctcgtctcctctggtggatatgtttg

SEQ ID NO: 2457 - DNA, 29 bp, Artificial Sequence
  Synthetic
ctaagttttcagggatggatggttcatgc

SEQ ID NO: 2458 - DNA, 25 bp, Artificial Sequence
  Synthetic
caaacatatccaccagaggagacga

SEQ ID NO: 2459 - DNA, 24 bp, Artificial Sequence
  Synthetic
ctctctcgtctcaactgtgtgggc

SEQ ID NO: 2460 - DNA, 24 bp, Artificial Sequence
  Synthetic
ttaagatctgtagtctttccgaac

SEQ ID NO: 2461 - DNA, 19 bp, Artificial Sequence
  Synthetic
gcccacacacttgagacga

SEQ ID NO: 2462 - DNA, 24 bp, Artificial Sequence
  Synthetic
ccgtcacgcctcctgttgcctccc

SEQ ID NO: 2463 - DNA, 20 bp, Artificial Sequence
  Synthetic
agcctccaacttcacgctgt

SEQ ID NO: 2464 - DNA, 18 bp, Artificial Sequence
  Synthetic
gggaggcaacaggaggcg

SEQ ID NO: 2465 - DNA, 31 bp, Artificial Sequence
  Synthetic
ccgccgagatcactgaagaggatgctgatgg

SEQ ID NO: 2466 - DNA, 25 bp, Artificial Sequence
  Synthetic
acaccacgttgttggcagagtcaag

SEQ ID NO: 2467 - DNA, 28 bp, Artificial Sequence
  Synthetic
ccatcagcatcctcttcagtgatctcgg

SEQ ID NO: 2468 - DNA, 25 bp, Artificial Sequence
  Synthetic
ccgtcacgcctcgccttagggttca

SEQ ID NO: 2469 - DNA, 24 bp, Artificial Sequence
  Synthetic
tctgggtcatcttttcacggttga

SEQ ID NO: 2470 - DNA, 19 bp, Artificial Sequence
  Synthetic
tgaaccctaaggcgaggcg

SEQ ID NO: 2471 - DNA, 17 bp, Artificial Sequence
  Synthetic
gaggggcctcggtgagc

SEQ ID NO: 2472 - DNA, 28 bp, Artificial Sequence
  Synthetic
ccgccgagatcacgagttcttgcctttc

SEQ ID NO: 2473 - DNA, 28 bp, Artificial Sequence
  Synthetic
ccgccgagatcacgagttcttgcctttc

SEQ ID NO: 2474 - DNA, 27 bp, Artificial Sequence
  Synthetic
ttcacacacgcttttcctggtatctcc

SEQ ID NO: 2475 - DNA, 21 bp, Artificial Sequence
  Synthetic
gaaaggcaagaactcgtgatc

SEQ ID NO: 2476 - DNA, 25 bp, Artificial Sequence
  Synthetic
ctctctcgtctcccagaaggccagt

SEQ ID NO: 2477 - DNA, 31 bp, Artificial Sequence
  Synthetic
ttcttcatctaggacaagtgtggaaccataa

SEQ ID NO: 2478 - DNA, 19 bp, Artificial Sequence
  Synthetic
actggccttctgggagacg

SEQ ID NO: 2479 - DNA, 27 bp, Artificial Sequence
  Synthetic
ccgtcacgcctctttcctcattctcct

SEQ ID NO: 2480 - DNA, 37 bp, Artificial Sequence
  Synthetic
cccaatttccattctcattattctccggaagtaaatc

SEQ ID NO: 2481 - DNA, 21 bp, Artificial Sequence
  Synthetic
aggagaatgaggaaagaggcg

SEQ ID NO: 2482 - DNA, 25 bp, Artificial Sequence
  Synthetic
ccgtcacgcctctgtctttcttcgc

SEQ ID NO: 2483 - DNA, 16 bp, Artificial Sequence
  Synthetic
gctgcaccgccacccc

SEQ ID NO: 2484 - DNA, 19 bp, Artificial Sequence
  Synthetic
gcgaagaaagacagaggcg

SEQ ID NO: 2485 - DNA, 28 bp, Artificial Sequence
  Synthetic
aacgaggcgcactcttcttattctcctg

SEQ ID NO: 2486 - DNA, 28 bp, Artificial Sequence
  Synthetic
aacgaggcgcactcttcttattctcctg

SEQ ID NO: 2487 - DNA, 23 bp, Artificial Sequence
  Synthetic
gtctcaaagtccaccacagtctc

SEQ ID NO: 2488 - DNA, 22 bp, Artificial Sequence
  Synthetic
caggagaataagaagagtgcgc

SEQ ID NO: 2489 - DNA, 26 bp, Artificial Sequence
  Synthetic
ccgtcacgcctctcttcttattctcc

SEQ ID NO: 2490 - DNA, 26 bp, Artificial Sequence
  Synthetic
ccgtcacgcctctcttcttattctcc

SEQ ID NO: 2491 - DNA, 23 bp, Artificial Sequence
  Synthetic
gtctcaaagtccaccacagtctc

SEQ ID NO: 2492 - DNA, 20 bp, Artificial Sequence
  Synthetic
ggagaataagaagagaggcg

SEQ ID NO: 2493 - DNA, 17 bp, Artificial Sequence
  Synthetic
tgggatgggtcctgggc

SEQ ID NO: 2494 - DNA, 28 bp, Artificial Sequence
  Synthetic
gaacggcaggtttggcactcttggcatt

SEQ ID NO: 2495 - DNA, 20 bp, Artificial Sequence
  Synthetic
caggtaggcgtaggtcttga

SEQ ID NO: 2496 - DNA, 23 bp, Artificial Sequence
  Synthetic
aatgccaagagtgccaaacctgc

SEQ ID NO: 2497 - DNA, 17 bp, Artificial Sequence
  Synthetic
ggctctgtgctgggcta

SEQ ID NO: 2498 - DNA, 24 bp, Artificial Sequence
  Synthetic
ccgtcacgcctcccgactccgtct

SEQ ID NO: 2499 - DNA, 18 bp, Artificial Sequence
  Synthetic
cgggtgcagcgcagcatt

SEQ ID NO: 2500 - DNA, 18 bp, Artificial Sequence
  Synthetic
agacggagtcgggaggcg

SEQ ID NO: 2501 - DNA, 29 bp, Artificial Sequence
  Synthetic
ccgtcacgcctctgtcacttgatcgttct

SEQ ID NO: 2502 - DNA, 29 bp, Artificial Sequence
  Synthetic
tggcctcataaactccgtattttagcaag

SEQ ID NO: 2503 - DNA, 23 bp, Artificial Sequence
  Synthetic
agaacgatcaagtgacagaggcg

SEQ ID NO: 2504 - DNA, 31 bp, Artificial Sequence
  Synthetic
ccgccgagatcacgtgtcctacgtttagaag

SEQ ID NO: 2505 - DNA, 34 bp, Artificial Sequence
  Synthetic
cacatgtacaataccctcctgcattttttcaatc

SEQ ID NO: 2506 - DNA, 28 bp, Artificial Sequence
  Synthetic
cttctaaacgtaggacacgtgatctcgg

SEQ ID NO: 2507 - DNA, 27 bp, Artificial Sequence
  Synthetic
ccgtcacgcctctcttctgaatcttgc

SEQ ID NO: 2508 - DNA, 21 bp, Artificial Sequence
  Synthetic
ctggcacttgttgcggttcta

SEQ ID NO: 2509 - DNA, 21 bp, Artificial Sequence
  Synthetic
gcaagattcagaagagaggcg

SEQ ID NO: 2510 - DNA, 21 bp, Artificial Sequence
  Synthetic
agctgcgctcacacttctcgt

SEQ ID NO: 2511 - DNA, 26 bp, Artificial Sequence
  Synthetic
ccgtcacgcctctcttctgaatcttg

SEQ ID NO: 2512 - DNA, 21 bp, Artificial Sequence
  Synthetic
ctggcacttgttgcggttcta

SEQ ID NO: 2513 - DNA, 20 bp, Artificial Sequence
  Synthetic
caagattcagaagagaggcg

SEQ ID NO: 2514 - DNA, 22 bp, Artificial Sequence
  Synthetic
cagctgcgctcacacttctcgt

SEQ ID NO: 2515 - DNA, 25 bp, Artificial Sequence
  Synthetic
ccgtcacgcctctcttctgaatctt

SEQ ID NO: 2516 - DNA, 22 bp, Artificial Sequence
  Synthetic
cctggcacttgttgcggttcta

SEQ ID NO: 2517 - DNA, 23 bp, Artificial Sequence
  Synthetic
gcagctgcgctcacacttctcgt

SEQ ID NO: 2518 - DNA, 27 bp, Artificial Sequence
  Synthetic
aacgaggcgcacggtaggcattgtaga

SEQ ID NO: 2519 - DNA, 31 bp, Artificial Sequence
  Synthetic
ccttctttttggtcatgttgaagtttttcac

SEQ ID NO: 2520 - DNA, 21 bp, Artificial Sequence
  Synthetic
tctacaatgcctaccgtgcgc

SEQ ID NO: 2521 - DNA, 21 bp, Artificial Sequence
  Synthetic
tgtgcttggagaaggccttca

SEQ ID NO: 2522 - DNA, 27 bp, Artificial Sequence
  Synthetic
ccgtcacgcctcgccacttgtttttca

SEQ ID NO: 2523 - DNA, 28 bp, Artificial Sequence
  Synthetic
ccatgcccataaagagcctttaacagga

SEQ ID NO: 2524 - DNA, 21 bp, Artificial Sequence
  Synthetic
tgaaaaacaagtggcgaggcg

SEQ ID NO: 2525 - DNA, 28 bp, Artificial Sequence
  Synthetic
ccgtcacgcctctttatgccttttgtga

SEQ ID NO: 2526 - DNA, 29 bp, Artificial Sequence
  Synthetic
tgcccattagtccaacaaaggaatctgta

SEQ ID NO: 2527 - DNA, 22 bp, Artificial Sequence
  Synthetic
tcacaaaaggcataaagaggcg

SEQ ID NO: 2528 - DNA, 27 bp, Artificial Sequence
  Synthetic
gagatctgaccatgcccataaagagcc

SEQ ID NO: 2529 - DNA, 26 bp, Artificial Sequence
  Synthetic
aacgaggcgcacgctggcaaacttgt

SEQ ID NO: 2530 - DNA, 27 bp, Artificial Sequence
  Synthetic
cctttctgtctttggagacttgcatca

SEQ ID NO: 2531 - DNA, 20 bp, Artificial Sequence
  Synthetic
acaagtttgccagcgtgcgc

SEQ ID NO: 2532 - DNA, 28 bp, Artificial Sequence
  Synthetic
acaactccatcaacactgtgctttgctg

SEQ ID NO: 2533 - DNA, 26 bp, Artificial Sequence
  Synthetic
aacgaggcgcactctaggaagtggca

SEQ ID NO: 2534 - DNA, 26 bp, Artificial Sequence
  Synthetic
gtgctgggcaatatgtctgtagagcg

SEQ ID NO: 2535 - DNA, 20 bp, Artificial Sequence
  Synthetic
tgccacttcctagagtgcgc

SEQ ID NO: 2536 - DNA, 17 bp, Artificial Sequence
  Synthetic
gccaggctggaaggagc

SEQ ID NO: 2537 - DNA, 27 bp, Artificial Sequence
  Synthetic
ccgccgagatcaccgtctcagtttggt

SEQ ID NO: 2538 - DNA, 36 bp, Artificial Sequence
  Synthetic
cgagtagtgacatggtaaaagttgtttgtattggct

SEQ ID NO: 2539 - DNA, 22 bp, Artificial Sequence
  Synthetic
accaaactgagacggtgatctc

SEQ ID NO: 2540 - DNA, 27 bp, Artificial Sequence
  Synthetic
ccgccgagatcaccacgttcacgggtt

SEQ ID NO: 2541 - DNA, 23 bp, Artificial Sequence
  Synthetic
gggagatccagtccactaatcca

SEQ ID NO: 2542 - DNA, 21 bp, Artificial Sequence
  Synthetic
aacccgtgaacgtggtgatct

SEQ ID NO: 2543 - DNA, 20 bp, Artificial Sequence
  Synthetic
gggactgtcgggacttcagg

SEQ ID NO: 2544 - DNA, 34 bp, Artificial Sequence
  Synthetic
gaacggcaggtttggggaattttctttatttctt

SEQ ID NO: 2545 - DNA, 21 bp, Artificial Sequence
  Synthetic
attccttcgcccagggtgatg

SEQ ID NO: 2546 - DNA, 28 bp, Artificial Sequence
  Synthetic
aagaaataaagaaaattccccaaacctg

SEQ ID NO: 2547 - DNA, 19 bp, Artificial Sequence
  Synthetic
cttttgtccccagcagtgt

SEQ ID NO: 2548 - DNA, 25 bp, Artificial Sequence
  Synthetic
aacgaggcgcacggtggtgttggga

SEQ ID NO: 2549 - DNA, 23 bp, Artificial Sequence
  Synthetic
gcctcatagcatcgcagaggtgt

SEQ ID NO: 2550 - DNA, 19 bp, Artificial Sequence
  Synthetic
tcccaacaccaccgtgcgc

SEQ ID NO: 2551 - DNA, 22 bp, Artificial Sequence
  Synthetic
cagagggcacggtgcatgttgt

SEQ ID NO: 2552 - DNA, 26 bp, Artificial Sequence
  Synthetic
gaacggcaggtttgtcagcagaccgc

SEQ ID NO: 2553 - DNA, 31 bp, Artificial Sequence
  Synthetic
gagaggccaaagtgagaccatgtgaaagaaa

SEQ ID NO: 2554 - DNA, 21 bp, Artificial Sequence
  Synthetic
gcggtctgctgacaaacctgc

SEQ ID NO: 2555 - DNA, 19 bp, Artificial Sequence
  Synthetic
catggatcggcatggcccc

SEQ ID NO: 2556 - DNA, 24 bp, Artificial Sequence
  Synthetic
aacgaggcgcacggtgtagggggg

SEQ ID NO: 2557 - DNA, 18 bp, Artificial Sequence
  Synthetic
gccctgctcacaggcaat

SEQ ID NO: 2558 - DNA, 18 bp, Artificial Sequence
  Synthetic
cccccctacaccgtgcgc

SEQ ID NO: 2559 - DNA, 26 bp, Artificial Sequence
  Synthetic
ccgtcacgcctcgtcagtgccttttc

SEQ ID NO: 2560 - DNA, 23 bp, Artificial Sequence
  Synthetic
cacctggcggatcacttccatgt

SEQ ID NO: 2561 - DNA, 20 bp, Artificial Sequence
  Synthetic
gaaaaggcactgacgaggcg

SEQ ID NO: 2562 - DNA, 25 bp, Artificial Sequence
  Synthetic
ccgtcacgcctccctcatcctcact

SEQ ID NO: 2563 - DNA, 25 bp, Artificial Sequence
  Synthetic
actctgactctgtgtcatagctctt

SEQ ID NO: 2564 - DNA, 19 bp, Artificial Sequence
  Synthetic
agtgaggatgagggaggcg

SEQ ID NO: 2565 - DNA, 27 bp, Artificial Sequence
  Synthetic
aacgaggcgcacggttttctagtgtca

SEQ ID NO: 2566 - DNA, 24 bp, Artificial Sequence
  Synthetic
ctcactctctggcagcatctgaat

SEQ ID NO: 2567 - DNA, 21 bp, Artificial Sequence
  Synthetic
tgacactagaaaaccgtgcgc

SEQ ID NO: 2568 - DNA, 14 bp, Artificial Sequence
  Synthetic
gctggcccagctgc

SEQ ID NO: 2569 - DNA, 25 bp, Artificial Sequence
  Synthetic
ccgccgagatcacggttatgcgctg

SEQ ID NO: 2570 - DNA, 16 bp, Artificial Sequence
  Synthetic
ccagggggaggtggtc

SEQ ID NO: 2571 - DNA, 20 bp, Artificial Sequence
  Synthetic
gcagcgcataaccgtgatct

SEQ ID NO: 2572 - DNA, 23 bp, Artificial Sequence
  Synthetic
ctcctctttcagcttgatgctgg

SEQ ID NO: 2573 - DNA, 29 bp, Artificial Sequence
  Synthetic
gaacggcaggtttgggtggtggttatgcg

SEQ ID NO: 2574 - DNA, 22 bp, Artificial Sequence
  Synthetic
agagggaaacatccagggggag

SEQ ID NO: 2575 - DNA, 24 bp, Artificial Sequence
  Synthetic
cgcataaccaccacccaaacctgc

SEQ ID NO: 2576 - DNA, 28 bp, Artificial Sequence
  Synthetic
ccgccgagatcacgagatgctgtatccc

SEQ ID NO: 2577 - DNA, 25 bp, Artificial Sequence
  Synthetic
ggtcaggttgctgaagaccatgttg

SEQ ID NO: 2578 - DNA, 22 bp, Artificial Sequence
  Synthetic
gggatacagcatctcgtgatct

SEQ ID NO: 2579 - DNA, 26 bp, Artificial Sequence
  Synthetic
ccgtcacgcctctgagcacatccacg

SEQ ID NO: 2580 - DNA, 23 bp, Artificial Sequence
  Synthetic
acatagtctctgccgctgtctta

SEQ ID NO: 2581 - DNA, 20 bp, Artificial Sequence
  Synthetic
cgtggatgtgctcagaggcg

SEQ ID NO: 2582 - DNA, 20 bp, Artificial Sequence
  Synthetic
tacacagtggccaggtcctt

SEQ ID NO: 2583 - DNA, 25 bp, Artificial Sequence
  Synthetic
gaacggcaggtttgtcccaaggcgg

SEQ ID NO: 2584 - DNA, 28 bp, Artificial Sequence
  Synthetic
gtcaaggagctttaggtttagctgttta

SEQ ID NO: 2585 - DNA, 28 bp, Artificial Sequence
  Synthetic
gtcaaggatctttaggtttagctgttta

SEQ ID NO: 2586 - DNA, 37 bp, Artificial Sequence
  Synthetic
gtcccagttgtcaaggatctttaggtttagctgttta

SEQ ID NO: 2587 - DNA, 19 bp, Artificial Sequence
  Synthetic
ccgccttgggacaaacctg

SEQ ID NO: 2588 - DNA, 27 bp, Artificial Sequence
  Synthetic
agccttcaaactgggacacatagtctc

SEQ ID NO: 2589 - DNA, 25 bp, Artificial Sequence
  Synthetic
ccgccgagatcacttctgtctcctt

SEQ ID NO: 2590 - DNA, 16 bp, Artificial Sequence
  Synthetic
ctcctgcctcaggccg

SEQ ID NO: 2591 - DNA, 19 bp, Artificial Sequence
  Synthetic
aaggagacagaggtgatct

SEQ ID NO: 2592 - DNA, 22 bp, Artificial Sequence
  Synthetic
ttccaggttatcccagaactcc

SEQ ID NO: 2593 - DNA, 29 bp, Artificial Sequence
  Synthetic
agaacggcagtctttctgttttcccaagg

SEQ ID NO: 2594 - DNA, 28 bp, Artificial Sequence
  Synthetic
ccagttgtcaaggagctttaggtttagt

SEQ ID NO: 2595 - DNA, 23 bp, Artificial Sequence
  Synthetic
ccttgggaaaacagaaagactgc

SEQ ID NO: 2596 - DNA, 27 bp, Artificial Sequence
  Synthetic
cggagccttcaaactgggacacatagt

SEQ ID NO: 2597 - DNA, 31 bp, Artificial Sequence
  Synthetic
agaacggcagtctttagaataggcgatctgt

SEQ ID NO: 2598 - DNA, 23 bp, Artificial Sequence
  Synthetic
cactcaggtctatgcttgtggct

SEQ ID NO: 2599 - DNA, 23 bp, Artificial Sequence
  Synthetic
acagatcgcctattctaagactg

SEQ ID NO: 2600 - DNA, 28 bp, Artificial Sequence
  Synthetic
gggatgtcgaacagctggagaagattct

SEQ ID NO: 2601 - DNA, 35 bp, Artificial Sequence
  Synthetic
ccgtcacgcctcctttacattttctatcgtatccg

SEQ ID NO: 2602 - DNA, 24 bp, Artificial Sequence
  Synthetic
ccttccttatcctggatcttggca

SEQ ID NO: 2603 - DNA, 29 bp, Artificial Sequence
  Synthetic
cggatacgatagaaaatgtaaaggaggcg

SEQ ID NO: 2604 - DNA, 35 bp, Artificial Sequence
  Synthetic
cgccgagatcacctttacattttctatcgtatccg

SEQ ID NO: 2605 - DNA, 24 bp, Artificial Sequence
  Synthetic
ccttccttatcctggatcttggca

SEQ ID NO: 2606 - DNA, 29 bp, Artificial Sequence
  Synthetic
cggatacgatagaaaatgtaaaggtgatc

SEQ ID NO: 2607 - DNA, 25 bp, Artificial Sequence
  Synthetic
catcttcgcggactggatcttggcc

SEQ ID NO: 2608 - DNA, 29 bp, Artificial Sequence
  Synthetic
gctgatcaggaggaattccttccttatct

SEQ ID NO: 2609 - DNA, 17 bp, Artificial Sequence
  Synthetic
ggccaagatccagtccg

SEQ ID NO: 2610 - DNA, 34 bp, Artificial Sequence
  Synthetic
ctctctcgtctcttacattttctatcgtatccga

SEQ ID NO: 2611 - DNA, 34 bp, Artificial Sequence
  Synthetic
ctctctcgtctctttacattttctatcgtatccg

SEQ ID NO: 2612 - DNA, 35 bp, Artificial Sequence
  Synthetic
ctctctcgtctcctttacattttctatcgtatccg

SEQ ID NO: 2613 - DNA, 34 bp, Artificial Sequence
  Synthetic
ctctctcgtctccctttacattttctatcgtatc

SEQ ID NO: 2614 - DNA, 31 bp, Artificial Sequence
  Synthetic
ctctctcgtctcgcctttacattttctatcg

SEQ ID NO: 2615 - DNA, 28 bp, Artificial Sequence
  Synthetic
ggaattccttccttatcctggatcttga

SEQ ID NO: 2616 - DNA, 29 bp, Artificial Sequence
  Synthetic
ggaattccttccttatcctggatcttggc

SEQ ID NO: 2617 - DNA, 24 bp, Artificial Sequence
  Synthetic
ccttccttatcctggatcttggca

SEQ ID NO: 2618 - DNA, 23 bp, Artificial Sequence
  Synthetic
ttccttatcctggatcttggcca

SEQ ID NO: 2619 - DNA, 23 bp, Artificial Sequence
  Synthetic
tccttatcctggatcttggccta

SEQ ID NO: 2620 - DNA, 28 bp, Artificial Sequence
  Synthetic
ccgtcacgcctcccttctggatgttgta

SEQ ID NO: 2621 - DNA, 19 bp, Artificial Sequence
  Synthetic
ccaggtgcagggttgacta

SEQ ID NO: 2622 - DNA, 22 bp, Artificial Sequence
  Synthetic
tacaacatccagaagggaggcg

SEQ ID NO: 2623 - DNA, 28 bp, Artificial Sequence
  Synthetic
cgccgagatcacccttctggatgttgta

SEQ ID NO: 2624 - DNA, 19 bp, Artificial Sequence
  Synthetic
ccaggtgcagggttgacta

SEQ ID NO: 2625 - DNA, 22 bp, Artificial Sequence
  Synthetic
tacaacatccagaagggtgatc

SEQ ID NO: 2626 - DNA, 30 bp, Artificial Sequence
  Synthetic
ccgtcacgcctcccttctggatgttgtaat

SEQ ID NO: 2627 - DNA, 19 bp, Artificial Sequence
  Synthetic
ccaggtgcagggttgacta

SEQ ID NO: 2628 - DNA, 24 bp, Artificial Sequence
  Synthetic
attacaacatccagaagggaggcg

SEQ ID NO: 2629 - DNA, 31 bp, Artificial Sequence
  Synthetic
ccgtcacgcctcccttctggatgttgtaatc

SEQ ID NO: 2630 - DNA, 19 bp, Artificial Sequence
  Synthetic
ccaggtgcagggttgacta

SEQ ID NO: 2631 - DNA, 25 bp, Artificial Sequence
  Synthetic
gattacaacatccagaagggaggcg

SEQ ID NO: 2632 - DNA, 31 bp, Artificial Sequence
  Synthetic
aacgaggcgcacatgttgtaatcagagaggg

SEQ ID NO: 2633 - DNA, 22 bp, Artificial Sequence
  Synthetic
tgcagggttgactctttctgga

SEQ ID NO: 2634 - DNA, 25 bp, Artificial Sequence
  Synthetic
ccctctctgattacaacatgtgcgc

SEQ ID NO: 2635 - DNA, 28 bp, Artificial Sequence
  Synthetic
catcttcgcggaccttctggatgttgta

SEQ ID NO: 2636 - DNA, 22 bp, Artificial Sequence
  Synthetic
ggaccaggtgcagggttgactt

SEQ ID NO: 2637 - DNA, 20 bp, Artificial Sequence
  Synthetic
tacaacatccagaaggtccg

SEQ ID NO: 2638 - DNA, 29 bp, Artificial Sequence
  Synthetic
catcttcgcggacttcacgttctcgatgg

SEQ ID NO: 2639 - DNA, 24 bp, Artificial Sequence
  Synthetic
ccctctttatcctggatcttggca

SEQ ID NO: 2640 - DNA, 23 bp, Artificial Sequence
  Synthetic
ccatcgagaacgtgaagtccgcg

SEQ ID NO: 2641 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVHNELLLEAPQARAEEVAALAKEAMEKAYPLAVPLEVEVGMGEDWLSAKGHHHHHH

SEQ ID NO: 2642 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 2643 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 2644 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 2645 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 2646 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLGPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 2647 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 2648 - protein, 833 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVHDELLLEAPQARAEEVAALAKEAMEKAYPLAVPLEVEVGMGEDWLSAKG

SEQ ID NO: 2649 - protein, 833 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKE

SEQ ID NO: 2650 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGHRAALSERLFANLWGRLEGEERLLWLYREVERPLSAVLAHMEATGVRLDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 2651 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLHRNLWGRLEGEERLLWLYREVERPLSAVLAHMEATGVRLDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 2652 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLLKRLEGEERLLWLYREVERPLSAVLAHMEATGVRLDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 2653 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSRVLAHMEATGVRLDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 2654 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRRDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 2655 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 2656 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLRALSLELAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 2657 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLRALSLEVAEEIRRLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 2658 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLRALSLEVAEEIARLEEEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 2659 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLRALSLEVAEEIARLEAEVFRLAGHPFNLNSRDQLERVLFDELRLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 2660 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLRALSLEVAEEIARLEAEVFRLAGHPFNLNSRDQLERVLFDELGLPAIGKTQKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 2661 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLRALSLEVAEEIARLEAEVFRLAGHPFNLNSRDQLERVLFDELGLPAIGKTEKTGKRSTSAAVLEALREAHPIVEKILQHRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 2662 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKNTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 2663 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYVDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 2664 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPSLVHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHNELVLEAPKERAEAVARLAKEVMEGVYPLAVPLEVEVGIGEDWLSAKEHHHHHH

SEQ ID NO: 2665 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRDGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIATQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVHNELLLEAPQARAEEVAALAKEAMEKAYPLAVPLEVEVGMGEDWLSAKGHHHHHH

SEQ ID NO: 2666 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAEAMAFNMPVQGTAADLMKLAMVKLFPRLREMGARMLLQVHNELLLEAPQARAEEVAALAKEAMEKAYPLAVPLEVEVGMGEDWLSAKGHHHHHH

SEQ ID NO: 2667 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2668 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2669 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLRGVRGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2670 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEYTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2671 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIREKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2672 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2673 - protein, 842 aa, Artificial Sequence
  Synthetic
MNSTPLFDLEEPPKRVLLVDGHHLAYRTFYALSLTTSRGEPVQMVYGFARSLLKALKEDGQAVVVVFDAKAPSFRHEAYEAYKAGRAPTPEDFPRQLALVKRLVDLLGLVRLEAPGYEADDVLGTLAKKAEREGMEVRILTGDRDFFQLLSEKVSVLLPDGTLVTPKDVQEKYGVPPERWVDFRALTGDRSDNIPGVAGIGEKTALRLLAEWGSVENLLKNLDRVKPDSLRRKIEAHLEDLHLSLDLARIRTDLPLEVDFKALRRRTPDLEGLRAFLEELEFGSLLHEFGLLGGEKPREEAPWPPPEGAFVGFLLSRKEPMWAELLALAAASGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2674 - protein, 838 aa, Artificial Sequence
  Synthetic
MNSLPLFEPKGRVLLVDGHHLAYRTFFALKGLTTSRGEPVQAVYGFAKSLLKALREDGDVVIVVFDAKAPSFRHQTYEAYKAGRAPTPEDFPRQLALIKEMVDLLGLERLEVPGFEADDVLATLAKKAEKEGYEVRILTADRDLYQLLSERISILHPEGYLITPEWLWEKYGLKPSQWVDYRALAGDPSDNIPGVKGIGEKTAAKLIREWGSLENLLKHLEQVKPASVREKILSHMEDLKLSLELSRVHTDLLLQVDFARRREPDREGLKAFLERLEFGSLLHEFGLLESPVAAEEAPWPPPEGAFVGYVLSRPEPMWAELNALAAAWGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2675 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtccacaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2676 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 2677 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 2678 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgtgggggaggcttgagggggaggagaggctcctttggctttaccgggaggtggagaggcccctttccgctgtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 2679 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 2680 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcccggcgctacggcggggagtggacggaggaggcgggggagcgggccgccctttccgagaggctcttcgccaacctgtgggggaggcttgagggggaggagaggctcctttggctttaccgggaggtggagaggcccctttccgctgtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 2681 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 2682 - DNA, 2499 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtccacgacgagctcctcctggaggccccccaagcgcgggccgaggaggtggcggctttggccaaggaggccatggagaaggcctatcccctcgccgtgcccctggaggtggaggtggggatgggggaggactggctttccgccaagggt

SEQ ID NO: 2683 - DNA, 2499 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacgacgagctggtcctcgaggccccaaaagagagggcggaggccgtggcccggctggccaaggaggtcatggagggggtgtatcccctggccgtgcccctggaggtggaggtggggataggggaggactggctctccgccaaggag

SEQ ID NO: 2684 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcggggcaccgggccgccctttccgagaggctcttcgccaacctgtgggggaggcttgagggggaggagaggctcctttggctttaccgggaggtggagaggcccctttccgctgtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 2685 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctccatcggaacctgtgggggaggcttgagggggaggagaggctcctttggctttaccgggaggtggagaggcccctttccgctgtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 2686 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgcttaagaggcttgagggggaggagaggctcctttggctttaccgggaggtggagaggcccctttccgctgtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 2687 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtccaccgggcccccgagccttataaagccctcagggacctgaaggaggcgcgggggcttctcgccaaagacctgagcgttctggccctgagggaaggccttggcctcccgcccggcgacgaccccatgctcctcgcctacctcctggacccttcgaacaccacccccgagggggtggcccggcgctacggcggggagtggacggaggaggcgggggagcgggccgccctttccgagaggctcttcgccaacctgtgggggaggcttgagggggaggagaggctcctttggctttaccgggaggtggagaggcccctttcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 2688 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccacgggggtgcgccgggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 2689 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccacgggggtgcgcctggacgtggcctatctccaggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 2690 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccacgggggtgcgcctggacgtggcctatctcagggccttgtccctggagcttgccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 2691 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccacgggggtgcgcctggacgtggcctatctcagggccttgtccctggaggtggccgaggagatccgccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 2692 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccacgggggtgcgcctggacgtggcctatctcagggccttgtccctggaggtggccgaggagatcgcccgcctcgaggaggaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 2693 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctaaggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 2694 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacgcaaaagaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 2695 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagcaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 2696 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagaacacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 2697 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacgtggaccccttgccggacctcatccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 2698 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccacgggggtgcgcctggacgtggcctatctcagggccttgtccctggaggtggccgaggagatcgcccgcctcgaggccgaggtcttccgcctggccggccaccccttcaacctcaactcccgggaccagctggaaagggtcctctttgacgagctagggcttcccgccatcggcaagacggagaagaccggcaagcgctccaccagcgccgccgtcctggaggccctccgcgaggcccaccccatcgtggagaagatcctgcagtaccgggagctcaccaagctgaagagcacctacattgaccccttgccgagcctcgtccaccccaggacgggccgcctccacacccgcttcaaccagacggccacggccacgggcaggctaagtagctccgatcccaacctccagaacatccccgtccgcaccccgcttgggcagaggatccgccgggccttcatcgccgaggaggggtggctattggtggccctggactatagccagatagagctcagggtgctggcccacctctccggcgacgagaacctgatccgggtcttccaggaggggcgggacatccacacggagaccgccagctggatgttcggcgtcccccgggaggccgtggaccccctgatgcgccgggcggccaagaccatcaacttcggggtcctctacggcatgtcggcccaccgcctctcccaggagctagccatcccttacgaggaggcccaggccttcattgagcgctactttcagagcttccccaaggtgcgggcctggattgagaagaccctggaggagggcaggaggcgggggtacgtggagaccctcttcggccgccgccgctacgtgccagacctagaggcccgggtgaagagcgtgcgggaggcggccgagcgcatggccttcaacatgcccgtccagggcaccgccgccgacctcatgaagctggctatggtgaagctcttccccaggctggaggaaatgggggccaggatgctccttcaggtccacaacgagctggtcctcgaggccccaaaagagagggcggaggccgtggcccggctggccaaggaggtcatggagggggtgtatcccctggccgtgcccctggaggtggaggtggggataggggaggactggctctccgccaaggagcaccaccaccaccaccac

SEQ ID NO: 2699 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcagggacggccgggtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatcgccacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtccacaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2700 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggaggccatggccttcaacatgcccgtccagggcaccgccgccgacctcatgaagctcgccatggtgaagctcttcccccgcctccgggagatgggggcccgcatgctcctccaggtccacaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2701 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2702 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2703 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccgaggggtcaggggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2704 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagtataccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2705 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcagggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2706 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2707 - DNA, 2526 bp, Artificial Sequence
  Synthetic
atgaattccaccccactttttgacctggaggaaccccccaagcgggtgcttctggtggacggccaccacctggcctaccgcaccttctatgccctgagcctcaccacctcccggggggagccggtgcagatggtctacggcttcgcccggagcctcctcaaggccttgaaggaggacggacaggcggtggtcgtggtctttgacgccaaggccccctccttccgccacgaggcctacgaggcctacaaggcgggccgggcccccaccccggaggacttcccccgccagctcgccttggtcaagcggctggtggaccttctgggcctggtccgcctcgaggccccggggtacgaggcggacgacgtcctgggcaccctggccaagaaggccgaaagggaggggatggaggtgcgcatcctcacgggagaccgggacttcttccagctcctctccgagaaggtctcggtcctcctgccggacgggaccctggtcaccccaaaggacgtccaggagaagtacggggtgcccccggagcgctgggtggacttccgcgccctcacgggggaccgctcggacaacatccccggggtggcggggataggggagaagaccgcccttcgactcctcgcagagtgggggagcgtggaaaacctcctgaagaacctggaccgggtaaagccggactcgctccggcgcaagatagaggcgcacctcgaggacctccacctctccttagacctggcccgcatccgcaccgacctccccctggaggtggactttaaggccctgcgccgcaggacccccgacctggagggcctgagggcctttttggaggagctggagttcggaagcctcctccacgagttcggcctcctgggaggggagaagccccgggaggaggccccctggcccccgcccgaaggggccttcgtgggcttcctcctttcccgcaaggagcccatgtgggcggagcttctggccctggcggcggcctcgggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2708 - DNA, 2514 bp, Artificial Sequence
  Synthetic
atgaattccctgcccctctttgagcccaagggccgggtgcttctggtggacggccaccacctggcctaccgtaccttttttgccctgaagggcctcaccaccagccgcggggagccggtccaggcggtgtacgggtttgccaagagccttttgaaggcgctaagggaagacggggatgtggtgatcgtggtgtttgacgccaaggccccctccttccgccaccagacctacgaggcctacaaggcggggcgggctcccacccccgaggactttccccggcagcttgcccttatcaaggagatggtggaccttttgggcctggagcgcctcgaggtgccgggctttgaagcggatgacgtcctggctaccctggccaagaaggcggaaaaggaaggctacgaagtgcgcatcctcaccgcggaccgggacctttaccagcttctttcggagcgaatctccatccttcacccggagggttacctgatcaccccggagtggctttgggagaagtatgggcttaagccttcccagtgggtggactaccgggccttggccggggacccttccgacaacatccccggcgtgaagggcatcggggagaagacggcggccaagctgatccgggagtggggaagcctggaaaaccttcttaagcacctggaacaggtgaaacctgcctccgtgcgggagaagatccttagccacatggaggacctcaagctatccctggagctatcccgggtgcacacggacttgctccttcaggtggacttcgcccggcgccgggagccggaccgggaggggcttaaggcctttttggagaggctggagttcggaagcctcctccacgagttcggcctgttggaaagcccggtggcggcggaggaagctccctggccgccccccgagggagccttcgtggggtacgttctttcccgccccgagcccatgtgggcggagcttaacgccttggccgccgcctggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2709 - DNA, 2505 bp, Artificial Sequence
  Synthetic
atggaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcagggacggccgggtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctccaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccacatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtccacgacgagctcctcctggaggccccccaagcgcgggccgaggaggtggcggctttggccaaggaggccatggagaaggcctatcccctcgccgtgcccctggaggtggaggtggggatgggggaggactggctttccgccaagggttag

SEQ ID NO: 2710 - protein, 840 aa, Artificial Sequence
  Synthetic
MNSEAMLPLFEPKGRVLLVDGHHLAYRTFFALKGLTTSRGEPVQAVYGFAKSLLKALREDGDAVIVVFDAEAPSFRHEAYGGYKAGRAPTPEDFPRQLALIKELVDLLGFTRLEVPGYEADDVLATLAKKAEKEGYEVRILTADKDLYQLLSDRIHVLHPEGYLITPAWLWEKYGLRPDQWADYRALTGDESDNLPGVKGIGEKTALKLLKEWGSLEALLKNLDRLKPAIREKILAHMDDLKLSWDLAKVRTDLPLEVDFAKRREPDREGLKAFLERLEFGSLLHEFGLLGGEKPREEAPWPPPEGAFVGFVLSRKEPMWADLLALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2711 - DNA, 2520 bp, Artificial Sequence
  Synthetic
atgaattccgaggcgatgcttccgctctttgaacccaaaggccgggtcctcctggtggacggccaccacctggcctaccgtaccttttttgccctgaagggcctcaccaccagccggggggagccggtccaggcggtgtacgggtttgccaagagccttttgaaggcgctaagagaagacggggacgcggtgatcgtggtctttgacgccgaggccccctccttccgccacgaggcctacggggggtacaaggcggggcgggctcccacccccgaggactttccccggcagcttgcccttatcaaggagctggtggacctcctggggtttacccgcctcgaggtccccggctacgaggcggacgacgttctcgccaccctggccaagaaggcggaaaaggaggggtacgaggtgcgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagaccgccctcaagctcctcaaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggaggggcttaaggcctttttggagaggctggagttcggcagcctcctccacgagttcggcctcctgggaggggagaagccccgggaggaggccccctggcccccgccggaaggggccttcgtgggctttgtgctttcccgcaaggagcccatgtgggccgatcttctggccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2712 - protein, 836 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRDGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVHDELLLEAPQARAEEVAALAKEAMEKAYPLAVPLEVEVGMGEDWLSAKG

SEQ ID NO: 2713 - DNA, 2511 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcagggacggccgggtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctccaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccacatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtccacgacgagctcctcctggaggccccccaagcgcgggccgaggaggtggcggctttggccaaggaggccatggagaaggcctatcccctcgccgtgcccctggaggtggaggtggggatgggggaggactggctttccgccaagggttag

SEQ ID NO: 2714 - protein, 836 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRDGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVHNELLLEAPQARAEEVAALAKEAMEKAYPLAVPLEVEVGMGEDWLSAKG

SEQ ID NO: 2715 - DNA, 2511 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcagggacggccgggtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctccaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccacatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtccacaacgagctcctcctggaggccccccaagcgcgggccgaggaggtggcggctttggccaaggaggccatggagaaggcctatcccctcgccgtgcccctggaggtggaggtggggatgggggaggactggctttccgccaagggttag

SEQ ID NO: 2716 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcagggacggccgggtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctccaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccacatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtccacaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2717 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRDGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVHNELLLEAPQARAEEVAALAKEAMEKAYPLAVPLEVEVGMGEDWLSAKGHHHHHH

SEQ ID NO: 2718 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttggggaagacgcaaaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtccacaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2719 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALGKTQKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVHNELLLEAPQARAEEVAALAKEAMEKAYPLAVPLEVEVGMGEDWLSAKGHHHHHH

SEQ ID NO: 2720 - DNA, 2526 bp, Artificial Sequence
  Synthetic
atgaattccaccccactttttgacctggaggaaccccccaagcgggtgcttctggtggacggccaccacctggcctaccgcaccttctatgccctgagcctcaccacctcccggggggagccggtgcagatggtctacggcttcgcccggagcctcctcaaggccttgaaggaggacggacaggcggtggtcgtggtctttgacgccaaggccccctccttccgccacgaggcctacgaggcctacaaggcgggccgggcccccaccccggaggacttcccccgccagctcgccttggtcaagcggctggtggaccttctgggctttacccgcctcgaggccccggggtacgaggcggacgacgtcctgggcaccctggccaagaaggccgaaagggaggggatggaggtgcgcatcctcacgggagaccgggacttcttccagctcctctccgagaaggtctcggtcctcctgccggacgggaccctggtcaccccaaaggacgtccaggagaagtacggggtgcccccggagcgctgggtggacttccgcgccctcacgggggaccgctcggacaacatccccggggtggcggggataggggagaagaccgcccttcgactcctcgcagagtgggggagcgtggaaaacctcctgaagaacctggaccgggtaaagccggactcgctccggcgcaagatagaggcgcacctcgaggacctccacctctccttagacctggcccgcatccgcaccgacctccccctggaggtggactttaaggccctgcgccgcaggacccccgacctggagggcctgagggcctttttggaggagctggagttcggaagcctcctccacgagttcggcctcctgggaggggagaagccccgggaggaggccccctggcccccgcccgaaggggccttcgtgggcttcctcctttcccgcaaggagcccatgtgggcggagcttctggccctggcggcggcctcgggcggccgcgtccaccgggcaacaagcccggttgaggccctggcggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2721 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctcgccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2722 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLAGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2723 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctcaagggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2724 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLKGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2725 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaagaagcttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2726 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRKKLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2727 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctcctcctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2728 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLLLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2729 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggctacgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2730 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGYVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2731 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagcacctggaccaggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2732 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKHLDQVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2733 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcacaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2734 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVHTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2735 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcacaccgacctcctcctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2736 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVHTDLLLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2737 - DNA, 2508 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcgtttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggt

SEQ ID NO: 2738 - protein, 836 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLVWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKG

SEQ ID NO: 2739 - DNA, 2508 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggtggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggt

SEQ ID NO: 2740 - protein, 836 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGVEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKG

SEQ ID NO: 2741 - DNA, 2508 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgaaacgaggggaaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggt

SEQ ID NO: 2742 - protein, 836 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRNEGKEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKG

SEQ ID NO: 2743 - DNA, 2508 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcttcgagggggaggagaagctcctttgcctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggt

SEQ ID NO: 2744 - protein, 836 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRFEGEEKLLCLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKG

SEQ ID NO: 2745 - DNA, 2508 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttccctttttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggt

SEQ ID NO: 2746 - protein, 836 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPFLKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKG

SEQ ID NO: 2747 - DNA, 2508 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgttttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggt

SEQ ID NO: 2748 - protein, 836 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPVLKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKG

SEQ ID NO: 2749 - DNA, 2508 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccagtttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggt

SEQ ID NO: 2750 - protein, 836 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPSLKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKG

SEQ ID NO: 2751 - DNA, 2508 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccggtgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggt

SEQ ID NO: 2752 - protein, 836 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTGAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKG

SEQ ID NO: 2753 - DNA, 2508 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcttagcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggt

SEQ ID NO: 2754 - protein, 836 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSLAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKG

SEQ ID NO: 2755 - DNA, 2508 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagccgtgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggt

SEQ ID NO: 2756 - protein, 836 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSRAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKG

SEQ ID NO: 2757 - DNA, 2508 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccaagttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggt

SEQ ID NO: 2758 - protein, 836 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPKLKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKG

SEQ ID NO: 2759 - DNA, 2508 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatcgccacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggt

SEQ ID NO: 2760 - protein, 836 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIATQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKG

SEQ ID NO: 2761 - DNA, 2508 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagccgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggt

SEQ ID NO: 2762 - protein, 836 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKPKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKG

SEQ ID NO: 2763 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcatcgtggtctttgacgccgaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2764 - DNA, 2514 bp, Artificial Sequence
  Synthetic
atgaattccctgcccctctttgagcccaagggccgggtgcttctggtggacggccaccacctggcctaccgtaccttttttgccctgaagggcctcaccaccagccgcggggagccggtccaggcggtgtacgggtttgccaagagccttttgaaggcgctaagggaagacggggatgtggtgatcgtggtgtttgacgccaaggccccctccttccgccaccagacctacgaggcctacaaggcggggcgggctcccacccccgaggactttccccggcagcttgcccttatcaaggagatggtggaccttttgggctttacccgcctcgaggtgccgggctttgaagcggatgacgtcctggctaccctggccaagaaggcggaaaaggaaggctacgaagtgcgcatcctcaccgcggaccgggacctttaccagcttctttcggagcgaatctccatccttcacccggagggttacctgatcaccccggagtggctttgggagaagtatgggcttaagccttcccagtgggtggactaccgggccttggccggggacccttccgacaacatccccggcgtgaagggcatcggggagaagacggcggccaagctgatccgggagtggggaagcctggaaaaccttcttaagcacctggaacaggtgaaacctgcctccgtgcgggagaagatccttagccacatggaggacctcaagctatccctggagctatcccgggtgcacacggacttgctccttcaggtggacttcgcccggcgccgggagccggaccgggaggggcttaaggcctttttggagaggctggagttcggaagcctcctccacgagttcggcctgttggaaagcccggtggcggcggaggaagctccctggccgccccccgagggagccttcgtggggtacgttctttcccgccccgagcccatgtgggcggagcttaacgccttggccgccgcctggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2765 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcatcgtggtctttgacgccgaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtatgggcttaagccttcccagtgggtggactaccgggccttggccggggacccttccgacaacatccccggcgtgaagggcatcggggagaagacggcggccaagctgatccgggagtggggaagcctggaaaaccttcttaagcacctggaacaggtgaaacctgcctccgtgcgggagaagatccttagccacatggaggacctcaagctatccctggagctatcccgggtgcacacggacttgctccttcaggtggacttcgcccggcgccgggagccggaccgggaggggcttaaggcctttttggagaggctggagttcggaagcctcctccacgagttcggcctgttggaaagcccggtggcggcggaggaagctccctggccgccccccgagggagccttcgtggggtacgttctttcccgccccgagcccatgtgggcggagcttaacgccttggccgccgcctggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2766 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVIVVFDAEAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLKPSQWVDYRALAGDPSDNIPGVKGIGEKTAAKLIREWGSLENLLKHLEQVKPASVREKILSHMEDLKLSLELSRVHTDLLLQVDFARRREPDREGLKAFLERLEFGSLLHEFGLLESPVAAEEAPWPPPEGAFVGYVLSRPEPMWAELNALAAAWGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2767 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcatcgtggtctttgacgccgaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagcacctggaacaggtgaaacctgcctccgtgcgggagaagatccttagccacatggaggacctcaagctatccctggagctatcccgggtgcacacggacttgctccttcaggtggacttcgcccggcgccgggagccggaccgggaggggcttaaggcctttttggagaggctggagttcggaagcctcctccacgagttcggcctgttggaaagcccggtggcggcggaggaagctccctggccgccccccgagggagccttcgtggggtacgttctttcccgccccgagcccatgtgggcggagcttaacgccttggccgccgcctggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2768 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVIVVFDAEAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKHLEQVKPASVREKILSHMEDLKLSLELSRVHTDLLLQVDFARRREPDREGLKAFLERLEFGSLLHEFGLLESPVAAEEAPWPPPEGAFVGYVLSRPEPMWAELNALAAAWGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2769 - DNA, 2532 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcatcgtggtctttgacgccgaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccggactcgctccggcgcaagatagaggcgcacctcgaggacctccacctctccttagacctggcccgcatccgcaccgacctccccctggaggtggactttaaggccctgcgccgcaggacccccgacctggagggcctgagggcctttttggaggagctggagttcggaagcctcctccacgagttcggcctcctgggaggggagaagccccgggaggaggccccctggcccccgcccgaaggggccttcgtgggcttcctcctttcccgcaaggagcccatgtgggcggagcttctggccctggcggcggcctcgggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2770 - protein, 844 aa, Artificial Sequence
  Synthetic
MNSEAMLPLFEPKGRVLLVDGHHLAYRTFFALKGLTTSRGEPVQAVYGFAKSLLKALKEDGYKAVIVVFDAEAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPDSLRRKIEAHLEDLHLSLDLARIRTDLPLEVDFKALRRRTPDLEGLRAFLEELEFGSLLHEFGLLGGEKPREEAPWPPPEGAFVGFLLSRKEPMWAELLALAAASGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2771 - DNA, 2532 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcatcgtggtctttgacgccgaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccgaaggacgtccaggagaagtacggggtgcccccggagcgctgggtggacttccgcgccctcacgggggaccgctcggacaacatccccggggtggcggggataggggagaagaccgcccttcgactcctcgcagagtgggggagcgtggaaaacctcctgaagaacctggaccgggtaaagccggactcgctccggcgcaagatagaggcgcacctcgaggacctccacctctccttagacctggcccgcatccgcaccgacctccccctggaggtggactttaaggccctgcgccgcaggacccccgacctggagggcctgagggcctttttggaggagctggagttcggaagcctcctccacgagttcggcctcctgggaggggagaagccccgggaggaggccccctggcccccgcccgaaggggccttcgtgggcttcctcctttcccgcaaggagcccatgtgggcggagcttctggccctggcggcggcctcgggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2772 - protein, 844 aa, Artificial Sequence
  Synthetic
MNSEAMLPLFEPKGRVLLVDGHHLAYRTFFALKGLTTSRGEPVQAVYGFAKSLLKALKEDGYKAVIVVFDAEAPSFRHEAYEAYKAGRAPTPEDFPRQLALIKELVDLLGFTRLEVPGYEADDVLATLAKKAEKEGYEVRILTADRDLYQLVSDRVAVLHPEGHLITPKDVQEKYGVPPERWVDFRALTGDRSDNIPGVAGIGEKTALRLLAEWGSVENLLKNLDRVKPDSLRRKIEAHLEDLHLSLDLARIRTDLPLEVDFKALRRRTPDLEGLRAFLEELEFGSLLHEFGLLGGEKPREEAPWPPPEGAFVGFLLSRKEPMWAELLALAAASGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2773 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcatcgtggtctttgacgccgaggccccctccttccgccacgaggcctacgaggcctacaaggcggggagggccccgacccccgaggacttcccccggcagctcgccctcatcaaggagctggtggacctcctggggtttacccgcctcgaggtgccgggctttgaagcggatgacgtcctggctaccctggccaagaaggcggaaaaggaaggctacgaagtgcgcatcctcaccgcggaccgggacctttaccagcttctttcggagcgaatctccatccttcacccggagggttacctgatcaccccggagtggctttgggagaagtatgggcttaagccttcccagtgggtggactaccgggccttggccggggacccttccgacaacatccccggcgtgaagggcatcggggagaagacggcggccaagctgatccgggagtggggaagcctggaaaaccttcttaagcacctggaacaggtgaaacctgcctccgtgcgggagaagatccttagccacatggaggacctcaagctatccctggagctatcccgggtgcacacggacttgctccttcaggtggacttcgcccggcgccgggagccggaccgggaggggcttaaggcctttttggagaggctggagttcggaagcctcctccacgagttcggcctgttggaaagcccggtggcggcggaggaagctccctggccgccccccgagggagccttcgtggggtacgttctttcccgccccgagcccatgtgggcggagcttaacgccttggccgccgcctggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2774 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVIVVFDAEAPSFRHEAYEAYKAGRAPTPEDFPRQLALIKELVDLLGFTRLEVPGFEADDVLATLAKKAEKEGYEVRILTADRDLYQLLSERISILHPEGYLITPEWLWEKYGLKPSQWVDYRALAGDPSDNIPGVKGIGEKTAAKLIREWGSLENLLKHLEQVKPASVREKILSHMEDLKLSLELSRVHTDLLLQVDFARRREPDREGLKAFLERLEFGSLLHEFGLLESPVAAEEAPWPPPEGAFVGYVLSRPEPMWAELNALAAAWGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2775 - DNA, 2514 bp, Artificial Sequence
  Synthetic
atgaattccctgcccctctttgagcccaagggccgggtgcttctggtggacggccaccacctggcctaccgtaccttttttgccctgaagggcctcaccaccagccgcggggagccggtccaggcggtgtacgggtttgccaagagccttttgaaggcgctaagggaagacggggatgtggtgatcgtggtctttgacgccgaggccccctccttccgccaccagacctacgaggcctacaaggcggggcgggctcccacccccgaggactttccccggcagcttgcccttatcaaggagatggtggaccttttgggcctggagcgcctcgaggtgccgggctttgaagcggatgacgtcctggctaccctggccaagaaggcggaaaaggaaggctacgaagtgcgcatcctcaccgcggaccgggacctttaccagcttctttcggagcgaatctccatccttcacccggagggttacctgatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2776 - protein, 838 aa, Artificial Sequence
  Synthetic
MNSLPLFEPKGRVLLVDGHHLAYRTFFALKGLTTSRGEPVQAVYGFAKSLLKALREDGDVVIVVFDAEAPSFRHQTYEAYKAGRAPTPEDFPRQLALIKEMVDLLGLERLEVPGFEADDVLATLAKKAEKEGYEVRILTADRDLYQLLSERISILHPEGYLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2777 - DNA, 3135 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccacgtcgacatgaccatgattacgccaagctatttaggtgacactatagaatactcaagctatgcatcaagcttggtaccgagctcggatccactagtaacggccgccagtgtgctggaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagagctttacggcacctcgaccgcaaaaaacttgatttgggtgatggttcacgtagtgggccatcgccc

SEQ ID NO: 2778 - protein, 1045 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHHVDMTMITPSYLGDTIEYSSYASSLVPSSDPLVTAASVLEFCRYPSHWRPLEHASRGPNSPYSESYYNSLAVVLQRRDWENPGVTQLNRLAAHPPFASWRNSEEARTDRPSQQLRSLNGEWDAPCSGALSAAGVVVTRSVTATLASALAPAPFAFFPSFLATFAGFPRQALNRGLPLGFRFRALRHLDRKKLDLGDGSRSGPSP

SEQ ID NO: 2779 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2780 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2781 - protein, 842 aa, Artificial Sequence
  Synthetic
MNSTPLFDLEEPPKRVLLVDGHHLAYRTFYALSLTTSRGEPVQMVYGFARSLLKALKEDGQAVVVVFDAKAPSFRHEAYEAYKAGRAPTPEDFPRQLALVKRLVDLLGFTRLEAPGYEADDVLGTLAKKAEREGMEVRILTGDRDFFQLLSEKVSVLLPDGTLVTPKDVQEKYGVPPERWVDFRALTGDRSDNIPGVAGIGEKTALRLLAEWGSVENLLKNLDRVKPDSLRRKIEAHLEDLHLSLDLARIRTDLPLEVDFKALRRRTPDLEGLRAFLEELEFGSLLHEFGLLGGEKPREEAPWPPPEGAFVGFLLSRKEPMWAELLALAAASGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2782 - protein, 838 aa, Artificial Sequence
  Synthetic
MNSLPLFEPKGRVLLVDGHHLAYRTFFALKGLTTSRGEPVQAVYGFAKSLLKALREDGDVVIVVFDAKAPSFRHQTYEAYKAGRAPTPEDFPRQLALIKEMVDLLGFTRLEVPGFEADDVLATLAKKAEKEGYEVRILTADRDLYQLLSERISILHPEGYLITPEWLWEKYGLKPSQWVDYRALAGDPSDNIPGVKGIGEKTAAKLIREWGSLENLLKHLEQVKPASVREKILSHMEDLKLSLELSRVHTDLLLQVDFARRREPDREGLKAFLERLEFGSLLHEFGLLESPVAAEEAPWPPPEGAFVGYVLSRPEPMWAELNALAAAWGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2783 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAEAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2784 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccgaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2785 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAEAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2786 - DNA, 2526 bp, Artificial Sequence
  Synthetic
atgaattccaccccactttttgacctggaggaaccccccaagcgggtgcttctggtggacggccaccacctggcctaccgcaccttctatgccctgagcctcaccacctcccggggggagccggtgcagatggtctacggcttcgcccggagcctcctcaaggccttgaaggaggacggacaggcggtggtcgtggtctttgacgccgaggccccctccttccgccacgaggcctacgaggcctacaaggcgggccgggcccccaccccggaggacttcccccgccagctcgccttggtcaagcggctggtggaccttctgggcctggtccgcctcgaggccccggggtacgaggcggacgacgtcctgggcaccctggccaagaaggccgaaagggaggggatggaggtgcgcatcctcacgggagaccgggacttcttccagctcctctccgagaaggtctcggtcctcctgccggacgggaccctggtcaccccaaaggacgtccaggagaagtacggggtgcccccggagcgctgggtggacttccgcgccctcacgggggaccgctcggacaacatccccggggtggcggggataggggagaagaccgcccttcgactcctcgcagagtgggggagcgtggaaaacctcctgaagaacctggaccgggtaaagccggactcgctccggcgcaagatagaggcgcacctcgaggacctccacctctccttagacctggcccgcatccgcaccgacctccccctggaggtggactttaaggccctgcgccgcaggacccccgacctggagggcctgagggcctttttggaggagctggagttcggaagcctcctccacgagttcggcctcctgggaggggagaagccccgggaggaggccccctggcccccgcccgaaggggccttcgtgggcttcctcctttcccgcaaggagcccatgtgggcggagcttctggccctggcggcggcctcgggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggtcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2787 - protein, 842 aa, Artificial Sequence
  Synthetic
MNSTPLFDLEEPPKRVLLVDGHHLAYRTFYALSLTTSRGEPVQMVYGFARSLLKALKEDGQAVVVVFDAEAPSFRHEAYEAYKAGRAPTPEDFPRQLALVKRLVDLLGLVRLEAPGYEADDVLGTLAKKAEREGMEVRILTGDRDFFQLLSEKVSVLLPDGTLVTPKDVQEKYGVPPERWVDFRALTGDRSDNIPGVAGIGEKTALRLLAEWGSVENLLKNLDRVKPDSLRRKIEAHLEDLHLSLDLARIRTDLPLEVDFKALRRRTPDLEGLRAFLEELEFGSLLHEFGLLGGEKPREEAPWPPPEGAFVGFLLSRKEPMWAELLALAAASGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2788 - DNA, 2514 bp, Artificial Sequence
  Synthetic
atgaattccctgcccctctttgagcccaagggccgggtgcttctggtggacggccaccacctggcctaccgtaccttttttgccctgaagggcctcaccaccagccgcggggagccggtccaggcggtgtacgggtttgccaagagccttttgaaggcgctaagggaagacggggatgtggtgatcgtggtctttgacgccgaggccccctccttccgccaccagacctacgaggcctacaaggcggggcgggctcccacccccgaggactttccccggcagcttgcccttatcaaggagatggtggaccttttgggcctggagcgcctcgaggtgccgggctttgaagcggatgacgtcctggctaccctggccaagaaggcggaaaaggaaggctacgaagtgcgcatcctcaccgcggaccgggacctttaccagcttctttcggagcgaatctccatccttcacccggagggttacctgatcaccccggagtggctttgggagaagtatgggcttaagccttcccagtgggtggactaccgggccttggccggggacccttccgacaacatccccggcgtgaagggcatcggggagaagacggcggccaagctgatccgggagtggggaagcctggaaaaccttcttaagcacctggaacaggtgaaacctgcctccgtgcgggagaagatccttagccacatggaggacctcaagctatccctggagctatcccgggtgcacacggacttgctccttcaggtggacttcgcccggcgccgggagccggaccgggaggggcttaaggcctttttggagaggctggagttcggaagcctcctccacgagttcggcctgttggaaagcccggtggcggcggaggaagctccctggccgccccccgagggagccttcgtggggtacgttctttcccgccccgagcccatgtgggcggagcttaacgccttggccgccgcctggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2789 - protein, 838 aa, Artificial Sequence
  Synthetic
MNSLPLFEPKGRVLLVDGHHLAYRTFFALKGLTTSRGEPVQAVYGFAKSLLKALREDGDVVIVVFDAEAPSFRHQTYEAYKAGRAPTPEDFPRQLALIKEMVDLLGLERLEVPGFEADDVLATLAKKAEKEGYEVRILTADRDLYQLLSERISILHPEGYLITPEWLWEKYGLKPSQWVDYRALAGDPSDNIPGVKGIGEKTAAKLIREWGSLENLLKHLEQVKPASVREKILSHMEDLKLSLELSRVHTDLLLQVDFARRREPDREGLKAFLERLEFGSLLHEFGLLESPVAAEEAPWPPPEGAFVGYVLSRPEPMWAELNALAAAWGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2790 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccgaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2791 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAEAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2792 - DNA, 2520 bp, Artificial Sequence
  Synthetic
atgaattcggaggcgatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccgaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2793 - protein, 840 aa, Artificial Sequence
  Synthetic
MNSEAMLPLFEPKGRVLLVDGHHLAYRTFHALKGLTTSRGEPVQAVYGFAKSLLKALKEDGDAVIVVFDAEAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2794 - DNA, 2517 bp, Artificial Sequence
  Synthetic
atgaattcggggatgctgcccctctttgagcccaagggccgggtcctcctggtggacggccaccacctggcctaccgcaccttctttgccctgaagggcctcaccaccagccggggggagccggtgcaggcggtctacggcttcgccaagagcctcctcaaggccctcaaggaggacggggacgcggtgatcgtggtctttgacgccgaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2795 - protein, 839 aa, Artificial Sequence
  Synthetic
MNSGMLPLFEPKGRVLLVDGHHLAYRTFFALKGLTTSRGEPVQAVYGFAKSLLKALKEDGDAVIVVFDAEAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2796 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcagagaggacggggacgcggtgatcgtggtctttgacgccgaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2797 - protein, 839 aa, Artificial Sequence
  Synthetic
MNSGMLPLFEPKGRVLLVDGHHLAYRTFHALKGLTTSRGEPVQAVYGFAKSLLKALREDGDAVIVVFDAEAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2798 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccgaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccaccctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2799 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAEAPSFRHEAYGGYKAGRAPTPEDFPRQLALIKELVDLLGFTRLEVPGYEADDVLATLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2800 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccgaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgctcaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2801 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAEAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVKGIGEKTALKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2802 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccgaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggaggggcttaaggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2803 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAEAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDREGLKAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2804 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccgaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctgggaggggagaagccccgggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2805 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAEAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLGGEKPREEAPWPPPEGAFVGFVLSRKEPMWADLLALAAARGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2806 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccgaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2807 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAEAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2808 - DNA, 2517 bp, Artificial Sequence
  Synthetic
atgaattcggggatgctgcccctctttgagcccaagggccgggtcctcctggtggacggccaccacctggcctaccgcaccttccacgccctgaagggcctcaccaccagccggggggagccggtgcaggcggtctacggcttcgccaagagcctcctcaaggccctcaaggaggacggggacgcggtgatcgtggtctttgacgccgaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctgaaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2809 - protein, 839 aa, Artificial Sequence
  Synthetic
MNSGMLPLFEPKGRVLLVDGHHLAYRTFHALKGLTTSRGEPVQAVYGFAKSLLKALKEDGDAVIVVFDAEAPSFRHEAYGGYKAGRAPTPEDFPRQLALIKELVDLLGFTRLEVPGYEADDVLASLAKKAEKEGYEVRILTADKDLYQLLSDRIHVLHPEGYLITPAWLWEKYGLRPDQWADYRALTGDESDNLPGVKGIGEKTARKLLKEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2810 - DNA, 2520 bp, Artificial Sequence
  Synthetic
atgaattcggaggcgatgctgcccctctttgagcccaagggccgggtcctcctggtggacggccaccacctggcctaccgcaccttctttgccctgaagggcctcaccaccagccggggggagccggtgcaggcggtctacggcttcgccaagagcctcctcaaggccctcagagaggacggggacgcggtgatcgtggtctttgacgccgaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccaccctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgctcaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggaggggcttaaggcctttctggagaggcttgagtttggcagcctcctccacgagttcggccttctgggaggggagaagccccgggaggaggccccctggcccccgccggaaggggccttcgtgggctttgtgctttcccgcaaggagcccatgtgggccgatcttctggccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2811 - protein, 840 aa, Artificial Sequence
  Synthetic
MNSEAMLPLFEPKGRVLLVDGHHLAYRTFFALKGLTTSRGEPVQAVYGFAKSLLKALREDGDAVIVVFDAEAPSFRHEAYGGYKAGRAPTPEDFPRQLALIKELVDLLGFTRLEVPGYEADDVLATLAKKAEKEGYEVRILTADKDLYQLLSDRIHVLHPEGYLITPAWLWEKYGLRPDQWADYRALTGDESDNLPGVKGIGEKTALKLLEEWGSLEALLKNLDRLKPAIREKILAHMDDLKLSWDLAKVRTDLPLEVDFAKRREPDREGLKAFLERLEFGSLLHEFGLLGGEKPREEAPWPPPEGAFVGFVLSRKEPMWADLLALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2812 - DNA, 2520 bp, Artificial Sequence
  Synthetic
atgaattcggaggcgatgctgcccctctttgagcccaagggccgggtcctcctggtggacggccaccacctggcctaccgcaccttctttgccctgaagggcctcaccaccagccggggggagccggtgcaggcggtctacggcttcgccaagagcctcctcaaggccctcagagaggacggggacgcggtgatcgtggtctttgacgccgaggccccctccttccgccacgaggcctacggggggtacaaggcgggccgggcccccacgccggaggactttccccggcaactcgccctcatcaaggagctggtggacctcctggggttcacgcgcctcgaggtcccgggctacgaggcggacgacgtcctggccaccctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgctcaagcttctgaaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggaggggcttaaggcctttctggagaggcttgagtttggcagcctcctccacgagttcggccttctgggaggggagaagccccgggaggaggccccctggcccccgccggaaggggccttcgtgggctttgtgctttcccgcaaggagcccatgtgggccgatcttctggccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2813 - protein, 840 aa, Artificial Sequence; identical to SEQ ID NO: 2710
  Synthetic

SEQ ID NO: 2814 - DNA, 2643 bp, Artificial Sequence
  Synthetic
atgggtgcggatattggtgacctctttgagagggaagaggtcgagcttgagtacttctcaggaaagaaaattgccgttgatgctttcaacacgctataccagttcatctcgataataaggcagcctgacggtacgccgttaaaggactcacagggcagaatcacctctcacctttccggaatcctatacagagtctccaacatggtcgaggtgggaatcaggccggtgtttgtattcgacggagagccaccggagttcaagaaggctgaaattgaggagaggaaaaagagaagggctgaggcagaggagatgtggattgcggctttgcaggcaggagataaggacgcgaaaaagtatgctcaggctgcagggagggttgacgagtacattgttgactccgcaaagacgcttttaagttacatggggattccctttgtcgatgccccgtctgaaggagaggcgcaggctgcttacatggcagcaaaaggcgatgtggagtacacaggaagccaggattacgattctctgctcttcggaagcccgagactcgccagaaatctcgcaataacgggaaaaaggaagcttcccggcaaaaatgtctatgtggatgtaaagccggagataataattctggaaagcaacctcaaaaggctgggtttgacgagggagcagctcatcgacatagcgattctggtcgggacggactacaatgagggtgtgaagggtgtcggcgtcaagaaggctttgaactacatcaagacctacggagatattttcagggcactcaaggctctgaaagtaaatattgaccacgtagaggagataaggaatttcttcctgaatcctcctgtgactgacgactacagaatagagttcagggagcctgactttgagaaggccatcgagttcctgtgcgaggagcacgacttcagcagggagagggtcgagaaggccttggagaagctcaaagctctgaagtcaacccaggccacgcttgagaggtggttcctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2815 - protein, 881 aa, Artificial Sequence
  Synthetic
MGADIGDLFEREEVELEYFSGKKIAVDAFNTLYQFISIIRQPDGTPLKDSQGRITSHLSGILYRVSNMVEVGIRPVFVFDGEPPEFKKAEIEERKKRRAEAEEMWIAALQAGDKDAKKYAQAAGRVDEYIVDSAKTLLSYMGIPFVDAPSEGEAQAAYMAAKGDVEYTGSQDYDSLLFGSPRLARNLAITGKRKLPGKNVYVDVKPEIIILESNLKRLGLTREQLIDIAILVGTDYNEGVKGVGVKKALNYIKTYGDIFRALKALKVNIDHVEEIRNFFLNPPVTDDYRIEFREPDFEKAIEFLCEEHDFSRERVEKALEKLKALKSTQATLERWFLEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2816 - DNA, 2619 bp, Artificial Sequence
  Synthetic
atgggtgcggatattggtgacctctttgagagggaagaggtcgagcttgagtacttctcaggaaagaaaattgccgttgatgctttcaacacgctataccagttcatctcgataataaggcagcctgacggtacgccgttaaaggactcacagggcagaatcacctctcacctttccggaatcctatacagagtctccaacatggtcgaggtgggaatcaggccggtgtttgtattcgacggagagccaccggagttcaagaaggctgaaattgaggagaggaaaaagagaagggctgaggcagaggagatgtggattgcggctttgcaggcaggagataaggacgcgaaaaagtatgctcaggctgcagggagggttgacgagtacattgttgactccgcaaagacgcttttaagttacatggggattccctttgtcgatgccccgtctgaaggagaggcgcaggctgcttacatggcagcaaaaggcgatgtggagtacacaggaagccaggattacgattctctgctcttcggaagcccgagactcgccagaaatctcgcaataacgggaaaaaggaagcttcccggcaaaaatgtctatgtggatgtaaagccggagataataattctggaaagcaacctcaaaaggctgggtttgacgagggagcagctcatcgacatagcgattctggtcgggacggactacaatgagggtgtgaagggtgtcggcgtcaagaaggctttgaactacatcaagacctacggagatattttcagggcactcaaggctctgaaagtaaatattgaccacgtagaggagataaggaatttcttcctgaatcctcctgtgactgacgactacagaatagagttcagggagcctgactttgagaaggccatcgagttcctgtgcgaggagcacgacttcagcagggagagggtcgagaaggccttggagaagctcaaagctctgaagtcaaccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2817 - protein, 873 aa, Artificial Sequence
  Synthetic
MGADIGDLFEREEVELEYFSGKKIAVDAFNTLYQFISIIRQPDGTPLKDSQGRITSHLSGILYRVSNMVEVGIRPVFVFDGEPPEFKKAEIEERKKRRAEAEEMWIAALQAGDKDAKKYAQAAGRVDEYIVDSAKTLLSYMGIPFVDAPSEGEAQAAYMAAKGDVEYTGSQDYDSLLFGSPRLARNLAITGKRKLPGKNVYVDVKPEIIILESNLKRLGLTREQLIDIAILVGTDYNEGVKGVGVKKALNYIKTYGDIFRALKALKVNIDHVEEIRNFFLNPPVTDDYRIEFREPDFEKAIEFLCEEHDFSRERVEKALEKLKALKSTLEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2818 - DNA, 2445 bp, Artificial Sequence
  Synthetic
atgaattccctgcccctctttgagcccaagggccgggtgcttctggtggacggccaccacctggcctaccgtaccttttttgccctgaagggcctcaccaccagccgcggggagccggtccaggcggtgtacgggtttgccaagagccttttgaaggcgctaagggaagacggggatgtggtgatcgtggtgtttgacgccaaggccccctccttccgccaccagacctacgaggcctacaaggcggggcgggctcccacccccgaggactttccccggcagcttgcccttatcaaggagatggtggaccttttgggcctggagcgcctcgaggtgccgggctttgaagcggatgacgtcctggctaccctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagggggagaagccccgggaggaggccccctggcccccgcccgaaggggccttcgtgggcttcctcctttcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2819 - protein, 815 aa, Artificial Sequence
  Synthetic
MNSLPLFEPKGRVLLVDGHHLAYRTFFALKGLTTSRGEPVQAVYGFAKSLLKALREDGDVVIVVFDAKAPSFRHQTYEAYKAGRAPTPEDFPRQLALIKEMVDLLGLERLEVPGFEADDVLATLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDREGEKPREEAPWPPPEGAFVGFLLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2820 - DNA, 2520 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccaccccggaggacttcccccgccagctcgccttggtcaagcggctggtggaccttctgggcctggtccgcctcgaggccccggggtacgaggcggacgacgtcctgggcaccctggccaagaaggccgaaaaggaggggtacgaggtgcgcatcctcaccgccgaccgcgacctctaccaactcgtctccgaccgcatccacgtcctccaccccgaggggtacctcatcaccccggagtggctttgggagaagtatgggcttaagccttcccagtgggtggactaccgggccttggccggggacccttccgacaacatccccggcgtgaagggcatcggggagaagacggcggccaagctgatccgggagtggggaagcctggaaaacctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2821 - protein, 840 aa, Artificial Sequence
  Synthetic
MNSEAMLPLFEPKGRVLLVDGHHLAYRTFFALKGLTTSRGEPVQAVYGFAKSLLKALKEDGDAVIVVFDAKAPSFRHEAYGGYKAGRAPTPEDFPRQLALVKRLVDLLGLVRLEAPGYEADDVLGTLAKKAEKEGYEVRILTADRDLYQLVSDRIHVLHPEGYLITPEWLWEKYGLKPSQWVDYRALAGDPSDNIPGVKGIGEKTAAKLIREWGSLENLLKNLDRLKPAIREKILAHMDDLKLSWDLAKVRTDLPLEVDFAKRREPDRERLRAFLERLEFGSLLHEFGLLESPKALEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2822 - DNA, 2445 bp, Artificial Sequence
  Synthetic
atgaattccctgcccctctttgagcccaagggccgggtgcttctggtggacggccaccacctggcctaccgtaccttttttgccctgaagggcctcaccaccagccgcggggagccggtccaggcggtgtacgggtttgccaagagccttttgaaggcgctaagggaagacggggatgtggtgatcgtggtgtttgacgccaaggccccctccttccgccaccagacctacgaggcctacaaggcggggcgggctcccacccccgaggactttccccggcagcttgcccttatcaaggagatggtggaccttttgggctttacccgcctcgaggtgccgggctttgaagcggatgacgtcctggctaccctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagggggagaagccccgggaggaggccccctggcccccgcccgaaggggccttcgtgggcttcctcctttcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2823 - protein, 815 aa, Artificial Sequence
  Synthetic
MNSLPLFEPKGRVLLVDGHHLAYRTFFALKGLTTSRGEPVQAVYGFAKSLLKALREDGDVVIVVFDAKAPSFRHQTYEAYKAGRAPTPEDFPRQLALIKEMVDLLGFTRLEVPGFEADDVLATLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDREGEKPREEAPWPPPEGAFVGFLLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2824 - DNA, 2520 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccaccccggaggacttcccccgccagctcgccttggtcaagcggctggtggaccttctgggctttacccgcctcgaggccccggggtacgaggcggacgacgtcctgggcaccctggccaagaaggccgaaaaggaggggtacgaggtgcgcatcctcaccgccgaccgcgacctctaccaactcgtctccgaccgcatccacgtcctccaccccgaggggtacctcatcaccccggagtggctttgggagaagtatgggcttaagccttcccagtgggtggactaccgggccttggccggggacccttccgacaacatccccggcgtgaagggcatcggggagaagacggcggccaagctgatccgggagtggggaagcctggaaaacctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2825 - protein, 840 aa, Artificial Sequence
  Synthetic
MNSEAMLPLFEPKGRVLLVDGHHLAYRTFFALKGLTTSRGEPVQAVYGFAKSLLKALKEDGDAVIVVFDAKAPSFRHEAYGGYKAGRAPTPEDFPRQLALVKRLVDLLGFTRLEAPGYEADDVLGTLAKKAEKEGYEVRILTADRDLYQLVSDRIHVLHPEGYLITPEWLWEKYGLKPSQWVDYRALAGDPSDNIPGVKGIGEKTAAKLIREWGSLENLLKNLDRLKPAIREKILAHMDDLKLSWDLAKVRTDLPLEVDFAKRREPDRERLRAFLERLEFGSLLHEFGLLESPKALEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2826 - DNA, 2445 bp, Artificial Sequence
  Synthetic
atgaattccctgcccctctttgagcccaagggccgggtgcttctggtggacggccaccacctggcctaccgtaccttttttgccctgaagggcctcaccaccagccgcggggagccggtccaggcggtgtacgggtttgccaagagccttttgaaggcgctaagggaagacggggatgtggtgatcgtggtctttgacgccgaggccccctccttccgccaccagacctacgaggcctacaaggcggggcgggctcccacccccgaggactttccccggcagcttgcccttatcaaggagatggtggaccttttgggcctggagcgcctcgaggtgccgggctttgaagcggatgacgtcctggctaccctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagggggagaagccccgggaggaggccccctggcccccgcccgaaggggccttcgtgggcttcctcctttcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2827 - protein, 815 aa, Artificial Sequence
  Synthetic
MNSLPLFEPKGRVLLVDGHHLAYRTFFALKGLTTSRGEPVQAVYGFAKSLLKALREDGDVVIVVFDAEAPSFRHQTYEAYKAGRAPTPEDFPRQLALIKEMVDLLGLERLEVPGFEADDVLATLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDREGEKPREEAPWPPPEGAFVGFLLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2828 - DNA, 2445 bp, Artificial Sequence
  Synthetic
atgaattccctgcccctctttgagcccaagggccgggtgcttctggtggacggccaccacctggcctaccgtaccttttttgccctgaagggcctcaccaccagccgcggggagccggtccaggcggtgtacgggtttgccaagagccttttgaaggcgctaagggaagacggggatgtggtgatcgtggtctttgacgccgaggccccctccttccgccaccagacctacgaggcctacaaggcggggcgggctcccacccccgaggactttccccggcagcttgcccttatcaaggagatggtggaccttttgggctttacccgcctcgaggtgccgggctttgaagcggatgacgtcctggctaccctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagggggagaagccccgggaggaggccccctggcccccgcccgaaggggccttcgtgggcttcctcctttcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2829 - protein, 815 aa, Artificial Sequence
  Synthetic
MNSLPLFEPKGRVLLVDGHHLAYRTFFALKGLTTSRGEPVQAVYGFAKSLLKALREDGDVVIVVFDAEAPSFRHQTYEAYKAGRAPTPEDFPRQLALIKEMVDLLGFTRLEVPGFEADDVLATLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDREGEKPREEAPWPPPEGAFVGFLLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2830 - DNA, 2520 bp, Artificial Sequence; identical to SEQ ID NO: 2711
  Synthetic

SEQ ID NO: 2831 - protein, 840 aa, Artificial Sequence; identical to SEQ ID NO: 2710
  Synthetic

SEQ ID NO: 2832 - DNA, 2526 bp, Artificial Sequence
  Synthetic
atgaattcggggatgctgcccctctttgagcccaagggccgggtgcttctggtggacggccaccacctggcctaccgcaccttcttcgccctgaagggcctcaccaccagccgcggggagccggtgcagatggtctacggcttcgcccggagcctcctcaaggccttgaaggaggacggacaggcggtggtcgtggtctttgacgccaaggccccctccttccgccacgaggcctacgaggcctacaaggcgggccgggcccccaccccggaggacttcccccggcagctcgcccttatcaaggagatggtggaccttttgggcctggcgcgcctcgaggtcccgggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagacggcggccaagctgatccgggagtggggaagcctggaaaaccttcttaagcacctggaacaggtgaaacctgcctccgtgcgggagaagatccttagccacatggaggacctcaagctatccctggagctatcccgggtgcacacggacttgctccttcaggtggactttaaggccctgcgccgcaggacccccgacctggagggcctgagggcctttttggaggagctggagttcggcagcctcctccacgagttcggcctcctggaggcccccgccgcggcggaggaagctccctggccgccccccgagggagccttcgtggggtacgttctttcccgccccgagcccatgtgggcggagcttaacgccttggccgccgcctggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctccaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccacatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2833 - protein, 842 aa, Artificial Sequence
  Synthetic
MNSGMLPLFEPKGRVLLVDGHHLAYRTFFALKGLTTSRGEPVQMVYGFARSLLKALKEDGQAVVVVFDAKAPSFRHEAYEAYKAGRAPTPEDFPRQLALIKEMVDLLGLARLEVPGYEADDVLATLAKKAEKEGYEVRILTADRDLYQLVSDRVAVLHPEGHLITPEWLWEKYGLRPEQWVDFRALVGDPSDNLPGVKGIGEKTAAKLIREWGSLENLLKHLEQVKPASVREKILSHMEDLKLSLELSRVHTDLLLQVDFKALRRRTPDLEGLRAFLEELEFGSLLHEFGLLEAPAAAEEAPWPPPEGAFVGYVLSRPEPMWAELNALAAAWGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2834 - DNA, 2511 bp, Artificial Sequence
  Synthetic
atggaattcctgcccctctttgagcccaagggccgggtgcttctggtggacggccaccacctggcctaccgcaccttccacgccctgaagggcctcaccaccagccgcggggagccggtccaggcggtgtacgggtttgccaagagccttttgaaggcgctaagagaagacggggatgtggtgatcgtggtctttgacgccaaggccccctccttccgccacgaggcctacggggggtacaaggcgggccgggccccgacccccgaggacttcccccggcagctcgccctcatcaaggagctggtggacctcctggggctggcgcgcctcgaggtgccgggctttgaagcggatgacgtcctggctaccctggccaagaaggcggaaaaggagggctacgaggtgcgcattctcaccggcgaccgcgacctttaccaactcgtctccgaccgcgtcgccgtcctccaccccgagggccacctcatcaccccggagtggctttgggagaagtacggcctcaggccggagcagtgggtggactaccgggccttggccggggacccttccgacaacatccccggcgtgaagggcatcggggagaagacggcgaggaagcttctggaggagtgggggagcgtggaagccctcctcaagaacctggaccggctgaagcccgccatccgggagaagatcctggcccacatggaggacctcaagctatccctggagctatcccgggtgcgcaccgacctccccctggaggtggacctcgcccaggggcgggagcccgaccgggaggggcttaaggcctttttggagaggctggagttcggaagcctcctccacgagttcggcctgttggaaagcccggtggcggcggaggaagctccctggccgccccccgagggagccttcgtggggtacgttctttcccgccccgagcccatgtgggcggagcttaacgccttggccgccgcctggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctccaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccacatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2835 - protein, 837 aa, Artificial Sequence
  Synthetic
MEFLPLFEPKGRVLLVDGHHLAYRTFHALKGLTTSRGEPVQAVYGFAKSLLKALREDGDVVIVVFDAKAPSFRHEAYGGYKAGRAPTPEDFPRQLALIKELVDLLGLARLEVPGFEADDVLATLAKKAEKEGYEVRILTGDRDLYQLVSDRVAVLHPEGHLITPEWLWEKYGLRPEQWVDYRALAGDPSDNIPGVKGIGEKTARKLLEEWGSVEALLKNLDRLKPAIREKILAHMEDLKLSLELSRVRTDLPLEVDLAQGREPDREGLKAFLERLEFGSLLHEFGLLESPVAAEEAPWPPPEGAFVGYVLSRPEPMWAELNALAAAWGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2836 - DNA, 2493 bp, Artificial Sequence
  Synthetic
atgaattccctgcccctctttgagcccaagggccgggtcctcctggtggacggccaccacctggcctaccgtaccttttttgccctgaagggcctcaccacctcccggggggagccggtgcagatggtctacggcttcgcccggagcctcctcaaggccctcaaggaggacggggacgcggtgatcgtggtctttgacgccgaggccccctccttccgccaccagacctacgaggcctacaaggcggggagggctcccacccccgaggactttccccggcagcttgcccttatcaaggagctggtggacctcctggggtttacccgcctcgaggtccccggctacgaggcggacgacgttctcgccaccctggccaagaaggcggaaaaggagggctacgaggtgcgcatcctcaccgcggaccgggacctttaccagcttctttccgaccgcattcacgtccttcaccccgaggggtacctcatcaccccggcctggctttgggaaaagtacggcttgaggcccgaccagtgggccgactaccgggccctgaccggggacgaatccgacaacctttccggggtcaagggcatcggggagaagacggcgaggaagcttctggaggagtgggggagcctggaagccctcctcaagaacctggaccggctgaagcccgccatccgggagaagatcctggcccacatggacgatctgaagctctccttggagctctcccgggtgcgcaccgacctccccctggaggtggacttcgccaaaaggcgggagcccgaccgggagaggcttagggcctttctggagaggcttgagtttggcagcctcctccacgagttcggccctttggaaagccccagggccgcggaggaagctccctggccgccccccgagggagccttcgtggggtacgttctttcccgccccgagcccatgtgggcggagcttaacgccttggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccatatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggt

SEQ ID NO: 2837 - protein, 831 aa, Artificial Sequence
  Synthetic
MNSLPLFEPKGRVLLVDGHHLAYRTFFALKGLTTSRGEPVQMVYGFARSLLKALKEDGDAVIVVFDAEAPSFRHQTYEAYKAGRAPTPEDFPRQLALIKELVDLLGFTRLEVPGYEADDVLATLAKKAEKEGYEVRILTADRDLYQLLSDRIHVLHPEGYLITPAWLWEKYGLRPDQWADYRALTGDESDNLSGVKGIGEKTARKLLEEWGSLEALLKNLDRLKPAIREKILAHMDDLKLSLELSRVRTDLPLEVDFAKRREPDRERLRAFLERLEFGSLLHEFGPLESPRAAEEAPWPPPEGAFVGYVLSRPEPMWAELNALAAARGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKG

SEQ ID NO: 2838 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccacatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2839 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLDPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2840 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctccaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccacatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2841 - protein, 842 aa, Artificial Sequence
  Synthetic
MNSEAMLPLFEPKGRVLLVDGHHLAYRTFFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRRDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2842 - DNA, 2526 bp, Artificial Sequence
  Synthetic
atgaattccgaggcgatgcttccgctctttgaacccaaaggccgggtcctcctggtggacggccaccacctggcctaccgcaccttcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctggacccttcgaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccacatggaggccaccggggtacggcgggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2843 - protein, 842 aa, Artificial Sequence; identical to SEQ ID NO: 37
  Synthetic

SEQ ID NO: 2844 - DNA, 2526 bp, Artificial Sequence
  Synthetic
atgaattccgaggcgatgcttccgctctttgaacccaaaggccgggtcctcctggtggacggccaccacctggcctaccgcacccgcttcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctccaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccacatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2845 - protein, 842 aa, Artificial Sequence
  Synthetic
MNSEAMLPLFEPKGRVLLVDGHHLAYRTRFALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2846 - DNA, 2526 bp, Artificial Sequence
  Synthetic
atgaattccgaggcgatgcttccgctctttgaacccaaaggccgggtcctcctggtggacggccaccacctggcctaccgcacccgccacgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctccaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccacatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2847 - protein, 842 aa, Artificial Sequence
  Synthetic
MNSEAMLPLFEPKGRVLLVDGHHLAYRTRHALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2848 - DNA, 2526 bp, Artificial Sequence
  Synthetic
atgaattccgaggcgatgcttccgctctttgaacccaaaggccgggtcctcctggtggacggccaccacctggcctaccgcacccgccgcgccctgaagggcctcaccacgagccggggcgaaccggtgcaggcggtctacggcttcgccaagagcctcctcaaggccctgaaggaggacgggtacaaggccgtcttcgtggtctttgacgccaaggccccctccttccgccacgaggcctacgaggcctacaaggcggggagggccccgacccccgaggacttcccccggcagctcgccctcatcaaggagctggtggacctcctggggtttacccgcctcgaggtccccggctacgaggcggacgacgttctcgccaccctggccaagaaggcggaaaaggaggggtacgaggtgcgcatcctcaccgccgaccgcgacctctaccaactcgtctccgaccgcgtcgccgtcctccaccccgagggccacctcatcaccccggagtggctttgggagaagtacggcctcaggccggagcagtgggtggacttccgcgccctcgtgggggacccctccgacaacctccccggggtcaagggcatcggggagaagaccgccctcaagctcctcaaggagtggggaagcctggaaaacctcctcaagaacctggaccgggtaaagccagaaaacgtccgggagaagatcaaggcccacctggaagacctcaggctctccttggagctctcccgggtgcgcaccgacctccccctggaggtggacctcgcccaggggcgggagcccgaccgggaggggcttagggccttcctggagaggctggagttcggcagcctcctccacgagttcggcctcctggaggcccccgcccccctggaggaggccccctggcccccgccggaaggggccttcgtgggcttcgtcctctcccgccccgagcccatgtgggcggagcttaaagccctggccgcctgcaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctccaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccacatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2849 - protein, 842 aa, Artificial Sequence
  Synthetic
MNSEAMLPLFEPKGRVLLVDGHHLAYRTRRALKGLTTSRGEPVQAVYGFAKSLLKALKEDGYKAVFVVFDAKAPSFRHEAYEAYKAGRAPTPEDFPRQLALIKELVDLLGFTRLEVPGYEADDVLATLAKKAEKEGYEVRILTADRDLYQLVSDRVAVLHPEGHLITPEWLWEKYGLRPEQWVDFRALVGDPSDNLPGVKGIGEKTALKLLKEWGSLENLLKNLDRVKPENVREKIKAHLEDLRLSLELSRVRTDLPLEVDLAQGREPDREGLRAFLERLEFGSLLHEFGLLEAPAPLEEAPWPPPEGAFVGFVLSRPEPMWAELKALAACRGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2850 - DNA, 2514 bp, Artificial Sequence
  Synthetic
atgaattccctgcccctctttgagcccaagggccgggtgcttctggtggacggccaccacctggcctaccgcacccgcttcgccctgaagggcctcaccaccagccgcggggagccggtccaggcggtgtacgggtttgccaagagccttttgaaggcgctaagggaagacggggatgtggtgatcgtggtgtttgacgccaaggccccctccttccgccaccagacctacgaggcctacaaggcggggcgggctcccacccccgaggactttccccggcagcttgcccttatcaaggagatggtggaccttttgggcctggagcgcctcgaggtgccgggctttgaagcggatgacgtcctggctaccctggccaagaaggcggaaaaggaaggctacgaagtgcgcatcctcaccgcggaccgggacctttaccagcttctttcggagcgaatctccatccttcacccggagggttacctgatcaccccggagtggctttgggagaagtatgggcttaagccttcccagtgggtggactaccgggccttggccggggacccttccgacaacatccccggcgtgaagggcatcggggagaagacggcggccaagctgatccgggagtggggaagcctggaaaaccttcttaagcacctggaacaggtgaaacctgcctccgtgcgggagaagatccttagccacatggaggacctcaagctatccctggagctatcccgggtgcacacggacttgctccttcaggtggacttcgcccggcgccgggagccggaccgggaggggcttaaggcctttttggagaggctggagttcggaagcctcctccacgagttcggcctgttggaaagcccggtggcggcggaggaagctccctggccgccccccgagggagccttcgtggggtacgttctttcccgccccgagcccatgtgggcggagcttaacgccttggccgccgcctggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctccaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccacatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2851 - protein, 838 aa, Artificial Sequence
  Synthetic
MNSLPLFEPKGRVLLVDGHHLAYRTRFALKGLTTSRGEPVQAVYGFAKSLLKALREDGDVVIVVFDAKAPSFRHQTYEAYKAGRAPTPEDFPRQLALIKEMVDLLGLERLEVPGFEADDVLATLAKKAEKEGYEVRILTADRDLYQLLSERISILHPEGYLITPEWLWEKYGLKPSQWVDYRALAGDPSDNIPGVKGIGEKTAAKLIREWGSLENLLKHLEQVKPASVREKILSHMEDLKLSLELSRVHTDLLLQVDFARRREPDREGLKAFLERLEFGSLLHEFGLLESPVAAEEAPWPPPEGAFVGYVLSRPEPMWAELNALAAAWGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2852 - DNA, 2514 bp, Artificial Sequence
  Synthetic
atgaattccctgcccctctttgagcccaagggccgggtgcttctggtggacggccaccacctggcctaccgcacccgccacgccctgaagggcctcaccaccagccgcggggagccggtccaggcggtgtacgggtttgccaagagccttttgaaggcgctaagggaagacggggatgtggtgatcgtggtgtttgacgccaaggccccctccttccgccaccagacctacgaggcctacaaggcggggcgggctcccacccccgaggactttccccggcagcttgcccttatcaaggagatggtggaccttttgggcctggagcgcctcgaggtgccgggctttgaagcggatgacgtcctggctaccctggccaagaaggcggaaaaggaaggctacgaagtgcgcatcctcaccgcggaccgggacctttaccagcttctttcggagcgaatctccatccttcacccggagggttacctgatcaccccggagtggctttgggagaagtatgggcttaagccttcccagtgggtggactaccgggccttggccggggacccttccgacaacatccccggcgtgaagggcatcggggagaagacggcggccaagctgatccgggagtggggaagcctggaaaaccttcttaagcacctggaacaggtgaaacctgcctccgtgcgggagaagatccttagccacatggaggacctcaagctatccctggagctatcccgggtgcacacggacttgctccttcaggtggacttcgcccggcgccgggagccggaccgggaggggcttaaggcctttttggagaggctggagttcggaagcctcctccacgagttcggcctgttggaaagcccggtggcggcggaggaagctccctggccgccccccgagggagccttcgtggggtacgttctttcccgccccgagcccatgtgggcggagcttaacgccttggccgccgcctggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctccaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccacatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2853 - protein, 838 aa, Artificial Sequence
  Synthetic
MNSLPLFEPKGRVLLVDGHHLAYRTRHALKGLTTSRGEPVQAVYGFAKSLLKALREDGDVVIVVFDAKAPSFRHQTYEAYKAGRAPTPEDFPRQLALIKEMVDLLGLERLEVPGFEADDVLATLAKKAEKEGYEVRILTADRDLYQLLSERISILHPEGYLITPEWLWEKYGLKPSQWVDYRALAGDPSDNIPGVKGIGEKTAAKLIREWGSLENLLKHLEQVKPASVREKILSHMEDLKLSLELSRVHTDLLLQVDFARRREPDREGLKAFLERLEFGSLLHEFGLLESPVAAEEAPWPPPEGAFVGYVLSRPEPMWAELNALAAAWGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2854 - DNA, 2514 bp, Artificial Sequence
  Synthetic
atgaattccctgcccctctttgagcccaagggccgggtgcttctggtggacggccaccacctggcctaccgcacccgccgcgccctgaagggcctcaccaccagccgcggggagccggtccaggcggtgtacgggtttgccaagagccttttgaaggcgctaagggaagacggggatgtggtgatcgtggtgtttgacgccaaggccccctccttccgccaccagacctacgaggcctacaaggcggggcgggctcccacccccgaggactttccccggcagcttgcccttatcaaggagatggtggaccttttgggcctggagcgcctcgaggtgccgggctttgaagcggatgacgtcctggctaccctggccaagaaggcggaaaaggaaggctacgaagtgcgcatcctcaccgcggaccgggacctttaccagcttctttcggagcgaatctccatccttcacccggagggttacctgatcaccccggagtggctttgggagaagtatgggcttaagccttcccagtgggtggactaccgggccttggccggggacccttccgacaacatccccggcgtgaagggcatcggggagaagacggcggccaagctgatccgggagtggggaagcctggaaaaccttcttaagcacctggaacaggtgaaacctgcctccgtgcgggagaagatccttagccacatggaggacctcaagctatccctggagctatcccgggtgcacacggacttgctccttcaggtggacttcgcccggcgccgggagccggaccgggaggggcttaaggcctttttggagaggctggagttcggaagcctcctccacgagttcggcctgttggaaagcccggtggcggcggaggaagctccctggccgccccccgagggagccttcgtggggtacgttctttcccgccccgagcccatgtgggcggagcttaacgccttggccgccgcctggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctccaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccacatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2855 - protein, 838 aa, Artificial Sequence
  Synthetic
MNSLPLFEPKGRVLLVDGHHLAYRTRRALKGLTTSRGEPVQAVYGFAKSLLKALREDGDVVIVVFDAKAPSFRHQTYEAYKAGRAPTPEDFPRQLALIKEMVDLLGLERLEVPGFEADDVLATLAKKAEKEGYEVRILTADRDLYQLLSERISILHPEGYLITPEWLWEKYGLKPSQWVDYRALAGDPSDNIPGVKGIGEKTAAKLIREWGSLENLLKHLEQVKPASVREKILSHMEDLKLSLELSRVHTDLLLQVDFARRREPDREGLKAFLERLEFGSLLHEFGLLESPVAAEEAPWPPPEGAFVGYVLSRPEPMWAELNALAAAWGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2856 - DNA, 2517 bp, Artificial Sequence
  Synthetic
atgaattcggggatgctgcccctctttgagcccaagggccgggtcctcctggtggacggccaccacctggcctaccgcacccgccacgccctgaagggcctcaccaccagccggggggagccggtgcaggcggtctacggcttcgccaagagcctcctcaaggccctcaaggaggacggggacgcggtgatcgtggtctttgacgccaaggccccctccttccgccacgaggcctacggggggtacaaggcgggccgggcccccacgccggaggactttccccggcaactcgccctcatcaaggagctggtggacctcctggggctggcgcgcctcgaggtcccgggctacgaggcggacgacgtcctggccagcctggccaagaaggcggaaaaggagggctacgaggtccgcatcctcaccgccgacaaagacctttaccagctcctttccgaccgcatccacgtcctccaccccgaggggtacctcatcaccccggcctggctttgggaaaagtacggcctgaggcccgaccagtgggccgactaccgggccctgaccggggacgagtccgacaaccttcccggggtcaagggcatcggggagaagacggcgaggaagcttctggaggagtgggggagcctggaagccctcctcaagaacctggaccggctgaagcccgccatccgggagaagatcctggcccacatggacgatctgaagctctcctgggacctggccaaggtgcgcaccgacctgcccctggaggtggacttcgccaaaaggcgggagcccgaccgggagaggcttagggcctttctggagaggcttgagtttggcagcctcctccacgagttcggccttctggaaagccccaaggccctggaggaggccccctggcccccgccggaaggggccttcgtgggctttgtgctttcccgcaaggagcccatgtgggccgatcttctggccctggccgccgccaggggcggccgcgtgcaccgggcagcagaccccttggcggggctaaaggacctcaaggaggtccggggcctcctcgccaaggacctcgccgtcttggcctcgagggaggggctagacctcgtgcccggggacgaccccatgctcctcgcctacctcctgggcccctccaacaccacccccgagggggtggcgcggcgctacgggggggagtggacggaggacgccgcccaccgggccctcctctcggagaggctccatcggaacctccttaagcgcctcgagggggaggagaagctcctttggctctaccacgaggtggaaaagcccctctcccgggtcctggcccacatggaggccaccggggtacggctggacgtggcctaccttcaggccctttccctggagcttgcggaggagatccgccgcctcgaggaggaggtcttccgcttggcgggccaccccttcaacctcaactcccgggaccagctggaaagggtgctctttgacgagcttaggcttcccgccttgaagaagacgaagaagacaggcaagcgctccaccagcgccgcggtgctggaggccctacgggaggcccaccccatcgtggagaagatcctccagcaccgggagctcaccaagctcaagaacacctacgtggaccccctcccaagcctcgtccacccgaggacgggccgcctccacacccgcttcaaccagacggccacggccacggggaggcttagtagctccgaccccaacctgcagaacatccccgtccgcacccccttgggccagaggatccgccgggccttcgtggccgaggcgggttgggcgttggtggccctggactatagccagatagagctccgcgtcctcgcccacctctccggggacgaaaacctgatcagggtcttccaggaggggaaggacatccacacccagaccgcaagctggatgttcggcgtccccccggaggccgtggaccccctgatgcgccgggcggccaagacggtgaacttcggcgtcctctacggcatgtccgcccataggctctcccaggagcttgccatcccctacgaggaggcggtggcctttatagagcgctacttccaaagcttccccaaggtgcgggcctggatagaaaagaccctggaggaggggaggaagcggggctacgtggaaaccctcttcggaagaaggcgctacgtgcccgacctcaacgcccgggtgaagagcgtcagggaggccgcggagcgcatggccttcaacatgcccgtccagggcaccgccgccgacctcatgaagctcgccatggtgaagctcttcccccgcctccgggagatgggggcccgcatgctcctccaggtcgccaacgagctcctcctggaggccccccaagcgcgggccgaggaggtggcggctttggccaaggaggccatggagaaggcctatcccctcgccgtgcccctggaggtggaggtggggatgggggaggactggctttccgccaagggtcaccaccaccaccaccac

SEQ ID NO: 2857 - protein, 839 aa, Artificial Sequence
  Synthetic
MNSGMLPLFEPKGRVLLVDGHHLAYRTRHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAADPLAGLKDLKEVRGLLAKDLAVLASREGLDLVPGDDPMLLAYLLGPSNTTPEGVARRYGGEWTEDAAHRALLSERLHRNLLKRLEGEEKLLWLYHEVEKPLSRVLAHMEATGVRLDVAYLQALSLELAEEIRRLEEEVFRLAGHPFNLNSRDQLERVLFDELRLPALKKTKKTGKRSTSAAVLEALREAHPIVEKILQHRELTKLKNTYVDPLPSLVHPRTGRLHTRFNQTATATGRLSSSDPNLQNIPVRTPLGQRIRRAFVAEAGWALVALDYSQIELRVLAHLSGDENLIRVFQEGKDIHTQTASWMFGVPPEAVDPLMRRAAKTVNFGVLYGMSAHRLSQELAIPYEEAVAFIERYFQSFPKVRAWIEKTLEEGRKRGYVETLFGRRRYVPDLNARVKSVREAAERMAFNMPVQGTAADLMKLAMVKLFPRLREMGARMLLQVANELLLEAPQARAEEVAALAKEAMEKAYPLAVPLEVEVGMGEDWLSAKGHHHHHH

SEQ ID NO: 2858 - DNA, 31 bp, Artificial Sequence
  Synthetic
cgcctacctcctggacccttcgaacaccacc

SEQ ID NO: 2859 - DNA, 31 bp, Artificial Sequence
  Synthetic
ggtggtgttcgaagggtccaggaggtaggcg

SEQ ID NO: 2860 - DNA, 28 bp, Artificial Sequence
  Synthetic
ggtacggcgggacgtggcctaccttcag

SEQ ID NO: 2861 - DNA, 28 bp, Artificial Sequence
  Synthetic
ctgaaggtaggccacgtcccgccgtacc

SEQ ID NO: 2862 - DNA, 39 bp, Artificial Sequence
  Synthetic
cacctggcctaccgcacccgcttcgccctgaagggcctc

SEQ ID NO: 2863 - DNA, 39 bp, Artificial Sequence
  Synthetic
gaggcccttcagggcgaagcgggtgcggtaggccaggtg

SEQ ID NO: 2864 - DNA, 42 bp, Artificial Sequence
  Synthetic
cacctggcctaccgcacccgccacgccctgaagggcctcacc

SEQ ID NO: 2865 - DNA, 42 bp, Artificial Sequence
  Synthetic
ggtgaggcccttcagggcgtggcgggtgcggtaggccaggtg

SEQ ID NO: 2866 - DNA, 42 bp, Artificial Sequence
  Synthetic
cacctggcctaccgcacccgccgcgccctgaagggcctcacc

SEQ ID NO: 2867 - DNA, 42 bp, Artificial Sequence
  Synthetic
ggtgaggcccttcagggcgcggcgggtgcggtaggccaggtg

SEQ ID NO: 2868 - DNA, 13 bp, Artificial Sequence
  Synthetic
  misc_feature (3)..(3): The residue at this position is linked to a Z28 quenching group.
cactgcttcgtgg

SEQ ID NO: 2869 - DNA, 27 bp, Artificial Sequence
  Synthetic
ccaggaagcaagtggtgcgcctcgttt

SEQ ID NO: 2870 - DNA, 27 bp, Artificial Sequence
  Synthetic
ccaggaagcaagtggaggcgtgacggt

SEQ ID NO: 2871 - DNA, 27 bp, Artificial Sequence
  Synthetic
ccaggaagcaagtgacgcagcgacggt

SEQ ID NO: 2872 - DNA, 24 bp, Artificial Sequence
  Synthetic
ccgtcacgcctcgtcatcagggat

SEQ ID NO: 2873 - DNA, 19 bp, Artificial Sequence
  Synthetic
ctcttctgggaagcccaga

SEQ ID NO: 2874 - DNA, 13 bp, Artificial Sequence
  Synthetic
cttgcaggcaggt

SEQ ID NO: 2875 - DNA, 17 bp, Artificial Sequence
  Synthetic
atccctgatgacgaggc

SEQ ID NO: 2876 - DNA, 22 bp, Artificial Sequence
  Synthetic
ccgtcacgcctccagcaggttg

SEQ ID NO: 2877 - DNA, 23 bp, Artificial Sequence
  Synthetic
actctagtttttccttctcctta

SEQ ID NO: 2878 - DNA, 15 bp, Artificial Sequence
  Synthetic
gcaatctcggtctgc

SEQ ID NO: 2879 - DNA, 16 bp, Artificial Sequence
  Synthetic
ccaaggtgctggaggc

SEQ ID NO: 2880 - DNA, 22 bp, Artificial Sequence
  Synthetic
ccgtcacgcctcagaggcaggg

SEQ ID NO: 2881 - DNA, 19 bp, Artificial Sequence
  Synthetic
ggctcagggtcattgaggc

SEQ ID NO: 2882 - DNA, 13 bp, Artificial Sequence
  Synthetic
tgaaggcctcctc

SEQ ID NO: 2883 - DNA, 15 bp, Artificial Sequence
  Synthetic
ccctgcctctgaggc

SEQ ID NO: 2884 - DNA, 26 bp, Artificial Sequence
  Synthetic
ccgtcacgcctcccttttgccagttg

SEQ ID NO: 2885 - DNA, 27 bp, Artificial Sequence
  Synthetic
gctctgcaggattttcatgtcaccata

SEQ ID NO: 2886 - DNA, 20 bp, Artificial Sequence
  Synthetic
ctccagatatccaagaagag

SEQ ID NO: 2887 - DNA, 20 bp, Artificial Sequence
  Synthetic
gaactggcaaaagggaggcg

SEQ ID NO: 2888 - DNA, 26 bp, Artificial Sequence
  Synthetic
aacgaggcgcacccttttgccagttg

SEQ ID NO: 2889 - DNA, 19 bp, Artificial Sequence
  Synthetic
gaactggcaaaagggtgcg

SEQ ID NO: 2890 - DNA, 26 bp, Artificial Sequence
  Synthetic
ccgtcacgcctcccttttgccagtta

SEQ ID NO: 2891 - DNA, 27 bp, Artificial Sequence
  Synthetic
gctctgcaggattttcatgtcaccata

SEQ ID NO: 2892 - DNA, 20 bp, Artificial Sequence
  Synthetic
ctccagatatccaagaagag

SEQ ID NO: 2893 - DNA, 20 bp, Artificial Sequence
  Synthetic
gaactggcaaaagggaggcg

SEQ ID NO: 2894 - DNA, 26 bp, Artificial Sequence
  Synthetic
ccgtcacgcctcccttttgccagttt

SEQ ID NO: 2895 - DNA, 25 bp, Artificial Sequence
  Synthetic
ccgtcacgcctcagttgtttccgtc

SEQ ID NO: 2896 - DNA, 27 bp, Artificial Sequence
  Synthetic
agaggtacaaacgaggttttccaaggc

SEQ ID NO: 2897 - DNA, 29 bp, Artificial Sequence
  Synthetic
agctaagatccctggatcagatttagaga

SEQ ID NO: 2898 - DNA, 19 bp, Artificial Sequence
  Synthetic
aacggaaacaactgaggcg

SEQ ID NO: 2899 - DNA, 25 bp, Artificial Sequence
  Synthetic
ccgtcacgcctcagttgtttccgtt

SEQ ID NO: 2900 - DNA, 25 bp, Artificial Sequence
  Synthetic
ccgtcacgcctcagttgtttccgtc

SEQ ID NO: 2901 - DNA, 16 bp, Artificial Sequence
  Synthetic
agctaagatccctgga

SEQ ID NO: 2902 - DNA, 25 bp, Artificial Sequence
  Synthetic
ccgtcacgcctcagttgtttccgtg

SEQ ID NO: 2903 - DNA, 25 bp, Artificial Sequence
  Synthetic
ccgtcacgcctctcatcttttgggg

SEQ ID NO: 2904 - DNA, 18 bp, Artificial Sequence
  Synthetic
ggtttggaagcagcccta

SEQ ID NO: 2905 - DNA, 21 bp, Artificial Sequence
  Synthetic
tccgtcaacttcaaagaacag

SEQ ID NO: 2906 - DNA, 19 bp, Artificial Sequence
  Synthetic
ccccaaaagatgagaggcg

SEQ ID NO: 2907 - DNA, 22 bp, Artificial Sequence
  Synthetic
ccgtcacgcctctgtcgttgct

SEQ ID NO: 2908 - DNA, 20 bp, Artificial Sequence
  Synthetic
cccaaggccacaggtattta

SEQ ID NO: 2909 - DNA, 19 bp, Artificial Sequence
  Synthetic
tggttctccttgtacaaag

SEQ ID NO: 2910 - DNA, 16 bp, Artificial Sequence
  Synthetic
agcaacgacagaggcg

SEQ ID NO: 2911 - DNA, 26 bp, Artificial Sequence
  Synthetic
ccgtcacgcctcctttcattacacag

SEQ ID NO: 2912 - DNA, 16 bp, Artificial Sequence
  Synthetic
gggtgggtgtgccgta

SEQ ID NO: 2913 - DNA, 20 bp, Artificial Sequence
  Synthetic
gacaggtatagattctttcc

SEQ ID NO: 2914 - DNA, 20 bp, Artificial Sequence
  Synthetic
ctgtgtaatgaaaggaggcg

SEQ ID NO: 2915 - DNA, 28 bp, Artificial Sequence
  Synthetic
ccgtcacgcctcccctttagttttacaa

SEQ ID NO: 2916 - DNA, 29 bp, Artificial Sequence
  Synthetic
gaattggcactcaaatgtgttgtcagaga

SEQ ID NO: 2917 - DNA, 32 bp, Artificial Sequence; identical to SEQ ID NO: 1053
  Synthetic

SEQ ID NO: 2918 - DNA, 23 bp, Artificial Sequence
  Synthetic
gttgtaaaactaaaggggaggcg

SEQ ID NO: 2919 - DNA, 27 bp, Artificial Sequence
  Synthetic
aacgaggcgcacccctttagttttaca

SEQ ID NO: 2920 - DNA, 21 bp, Artificial Sequence
  Synthetic
acagttactctgatattgctg

SEQ ID NO: 2921 - DNA, 21 bp, Artificial Sequence
  Synthetic
ttgtaaaactaaaggcgtgcg

SEQ ID NO: 2922 - DNA, 28 bp, Artificial Sequence
  Synthetic
ccgtcacgcctcccctttagttttacaa

SEQ ID NO: 2923 - DNA, 20 bp, Artificial Sequence
  Synthetic
cagttactctgatattgctg

SEQ ID NO: 2924 - DNA, 20 bp, Artificial Sequence
  Synthetic
tgtaaaactaaaggggaggc

SEQ ID NO: 2925 - DNA, 21 bp, Artificial Sequence
  Synthetic
acagttactctgatattgctg

SEQ ID NO: 2926 - DNA, 23 bp, Artificial Sequence
  Synthetic
ccgtcacgcctcctcctgtgacc

SEQ ID NO: 2927 - DNA, 29 bp, Artificial Sequence
  Synthetic
acatccatctccgtgcatggcgtccctta

SEQ ID NO: 2928 - DNA, 29 bp, Artificial Sequence
  Synthetic
tcggttcaaaatgccgatgatctctctca

SEQ ID NO: 2929 - DNA, 17 bp, Artificial Sequence
  Synthetic
ggtcacaggaggaggcg

SEQ ID NO: 2930 - DNA, 23 bp, Artificial Sequence
  Synthetic
ccgtcacgcctcctcctgtgacc

SEQ ID NO: 2931 - DNA, 20 bp, Artificial Sequence
  Synthetic
tcggttcaaaatgccgatga

SEQ ID NO: 2932 - DNA, 23 bp, Artificial Sequence
  Synthetic
ccgtcacgcctcctcctgtgaca

SEQ ID NO: 2933 - DNA, 22 bp, Artificial Sequence
  Synthetic
ccgtcacgcctcctcctgtgac

SEQ ID NO: 2934 - DNA, 21 bp, Artificial Sequence
  Synthetic
ctcggttcaaaatgccgatga

SEQ ID NO: 2935 - DNA, 23 bp, Artificial Sequence
  Synthetic
ccgtcacgcctcctcctgtgact

SEQ ID NO: 2936 - DNA, 25 bp, Artificial Sequence
  Synthetic
ccgtcacgcctctcttttctcattt

SEQ ID NO: 2937 - DNA, 32 bp, Artificial Sequence
  Synthetic
gttcatacaatcagaattgccattgcacaaca

SEQ ID NO: 2938 - DNA, 19 bp, Artificial Sequence
  Synthetic
ccacgatttcccagagaac

SEQ ID NO: 2939 - DNA, 18 bp, Artificial Sequence
  Synthetic
aaatgagaaaagagaggc

SEQ ID NO: 2940 - DNA, 22 bp, Artificial Sequence
  Synthetic
ccgtcacgcctcagggaaggcc

SEQ ID NO: 2941 - DNA, 22 bp, Artificial Sequence
  Synthetic
tcctctccggacttgtgaagtc

SEQ ID NO: 2942 - DNA, 17 bp, Artificial Sequence
  Synthetic
gtggttgtcaccagcat

SEQ ID NO: 2943 - DNA, 15 bp, Artificial Sequence
  Synthetic
ggccttccctgagcc

SEQ ID NO: 2944 - DNA, 23 bp, Artificial Sequence
  Synthetic
ccgtcacgcctcagtggtatcct

SEQ ID NO: 2945 - DNA, 22 bp, Artificial Sequence
  Synthetic
ggtatagacaggtctgttgggc

SEQ ID NO: 2946 - DNA, 15 bp, Artificial Sequence
  Synthetic
ctgtgaagtctcctc

SEQ ID NO: 2947 - DNA, 16 bp, Artificial Sequence
  Synthetic
aggataccactgaggc

SEQ ID NO: 2948 - DNA, 22 bp, Artificial Sequence
  Synthetic
ccgtcacgcctcggttctccac

SEQ ID NO: 2949 - DNA, 22 bp, Artificial Sequence
  Synthetic
caggctggaaatggaggctgca

SEQ ID NO: 2950 - DNA, 22 bp, Artificial Sequence
  Synthetic
gaaggacacggtgtcgttgtca

SEQ ID NO: 2951 - DNA, 16 bp, Artificial Sequence
  Synthetic
gtggagaaccgaggcg

SEQ ID NO: 2952 - DNA, 25 bp, Artificial Sequence
  Synthetic
ccgtcacgcctcctgtacacgagag

SEQ ID NO: 2953 - DNA, 23 bp, Artificial Sequence
  Synthetic
ggtggtgatggtggtgatggcta

SEQ ID NO: 2954 - DNA, 21 bp, Artificial Sequence
  Synthetic
agagagaccgggatagatagc

SEQ ID NO: 2955 - DNA, 18 bp, Artificial Sequence
  Synthetic
ctctcgtgtacaggaggc

SEQ ID NO: 2956 - DNA, 23 bp, Artificial Sequence
  Synthetic
aacgaggcgcacccaccaagagg

SEQ ID NO: 2957 - DNA, 30 bp, Artificial Sequence
  Synthetic
aggcgtccagaagaggaagaagacaacaaa

SEQ ID NO: 2958 - DNA, 16 bp, Artificial Sequence
  Synthetic
atgagcctaatggctc

SEQ ID NO: 2959 - DNA, 17 bp, Artificial Sequence
  Synthetic
cctcttggtgggtgcgc

SEQ ID NO: 2960 - DNA, 20 bp, Artificial Sequence
  Synthetic
atgagcctaatggctctggc

SEQ ID NO: 2961 - DNA, 27 bp, Artificial Sequence
  Synthetic
aacgaggcgcacgcttgactactaaca

SEQ ID NO: 2962 - DNA, 18 bp, Artificial Sequence
  Synthetic
ggctgtgcaccgcgtttc

SEQ ID NO: 2963 - DNA, 14 bp, Artificial Sequence
  Synthetic
cattccagctccgt

SEQ ID NO: 2964 - DNA, 21 bp, Artificial Sequence
  Synthetic
tgttagtagtcaagcgtccgc

SEQ ID NO: 2965 - DNA, 23 bp, Artificial Sequence
  Synthetic
aacgaggcgcacgttccatcttc

SEQ ID NO: 2966 - DNA, 21 bp, Artificial Sequence
  Synthetic
ctgtgaaggggtactggtcac

SEQ ID NO: 2967 - DNA, 14 bp, Artificial Sequence
  Synthetic
tcctgcgacttctc

SEQ ID NO: 2968 - DNA, 17 bp, Artificial Sequence
  Synthetic
gaagatggaacgtgcgc

SEQ ID NO: 2969 - DNA, 21 bp, Artificial Sequence
  Synthetic
aacgaggcgcacccctctgtt

SEQ ID NO: 2970 - DNA, 26 bp, Artificial Sequence
  Synthetic
tcctgtagtttctgagtcaaagagta

SEQ ID NO: 2971 - DNA, 17 bp, Artificial Sequence
  Synthetic
cttgaagttctctggcg

SEQ ID NO: 2972 - DNA, 15 bp, Artificial Sequence
  Synthetic
aacagaggggtgcgc

SEQ ID NO: 2973 - DNA, 22 bp, Artificial Sequence
  Synthetic
ccgtcacgcctcccctctgttc

SEQ ID NO: 2974 - DNA, 16 bp, Artificial Sequence
  Synthetic
gaacagaggggaggcg

SEQ ID NO: 2975 - DNA, 25 bp, Artificial Sequence
  Synthetic
ccgtcacgcctcagatgatctgagt

SEQ ID NO: 2976 - DNA, 27 bp, Artificial Sequence
  Synthetic
acaggcttgtcactcgaattttgagac

SEQ ID NO: 2977 - DNA, 13 bp, Artificial Sequence
  Synthetic
gtgagggtctggg

SEQ ID NO: 2978 - DNA, 19 bp, Artificial Sequence
  Synthetic
actcagatcatctgaggcg

SEQ ID NO: 2979 - DNA, 25 bp, Artificial Sequence
  Synthetic
aacgaggcgcactgatgatctgagt

SEQ ID NO: 2980 - DNA, 19 bp, Artificial Sequence
  Synthetic
actcagatcatctgtgcgc

SEQ ID NO: 2981 - DNA, 24 bp, Artificial Sequence
  Synthetic
ccgtcacgcctctgggaacttctc

SEQ ID NO: 2982 - DNA, 22 bp, Artificial Sequence
  Synthetic
actgatgagagggaggccatta

SEQ ID NO: 2983 - DNA, 14 bp, Artificial Sequence
  Synthetic
atccctttggggac

SEQ ID NO: 2984 - DNA, 18 bp, Artificial Sequence
  Synthetic
gagaagttcccagaggcg

SEQ ID NO: 2985 - DNA, 22 bp, Artificial Sequence
  Synthetic
ccgtcacgcctcctgagtagtt

SEQ ID NO: 2986 - DNA, 21 bp, Artificial Sequence
  Synthetic
tgtcccagcatcttgtgttta

SEQ ID NO: 2987 - DNA, 18 bp, Artificial Sequence
  Synthetic
gttgaaagctctgagcac

SEQ ID NO: 2988 - DNA, 16 bp, Artificial Sequence
  Synthetic
aactactcaggaggcg

SEQ ID NO: 2989 - DNA, 22 bp, Artificial Sequence
  Synthetic
aacgaggcgcacctctggcaag

SEQ ID NO: 2990 - DNA, 16 bp, Artificial Sequence
  Synthetic
ggggccgcaacaggga

SEQ ID NO: 2991 - DNA, 13 bp, Artificial Sequence
  Synthetic
cgggggacacccg

SEQ ID NO: 2992 - DNA, 17 bp, Artificial Sequence
  Synthetic
ctttgccagaggtgcgc

SEQ ID NO: 2993 - DNA, 24 bp, Artificial Sequence
  Synthetic
ccgtcacgcctccatgctctgttt

SEQ ID NO: 2994 - DNA, 16 bp, Artificial Sequence
  Synthetic
ggccaggttcagggta

SEQ ID NO: 2995 - DNA, 16 bp, Artificial Sequence
  Synthetic
caggatcttggggtta

SEQ ID NO: 2996 - DNA, 17 bp, Artificial Sequence
  Synthetic
aaacagagcatggaggc

SEQ ID NO: 2997 - DNA, 23 bp, Artificial Sequence
  Synthetic
ccgtcacgcctcagttgctgagg

SEQ ID NO: 2998 - DNA, 18 bp, Artificial Sequence
  Synthetic
cagcgcgcctgggttgac

SEQ ID NO: 2999 - DNA, 14 bp, Artificial Sequence
  Synthetic
tttgcgtagaccgg

SEQ ID NO: 3000 - DNA, 16 bp, Artificial Sequence
  Synthetic
cctcagcaactgaggc

SEQ ID NO: 3001 - DNA, 25 bp, Artificial Sequence
  Synthetic
ccgtcacgcctccatgctctgtttc

SEQ ID NO: 3002 - DNA, 17 bp, Artificial Sequence
  Synthetic
aggatcttggggttact

SEQ ID NO: 3003 - DNA, 18 bp, Artificial Sequence
  Synthetic
gaaacagagcatggaggc

SEQ ID NO: 3004 - DNA, 23 bp, Artificial Sequence
  Synthetic
ccgtcacgcctccgtagaccggc

SEQ ID NO: 3005 - DNA, 25 bp, Artificial Sequence
  Synthetic
ctgggttgaagttgctgaggtttga

SEQ ID NO: 3006 - DNA, 15 bp, Artificial Sequence
  Synthetic
ggctcgctgtgcagg

SEQ ID NO: 3007 - DNA, 16 bp, Artificial Sequence
  Synthetic
gccggtctacggaggc

SEQ ID NO: 3008 - DNA, 22 bp, Artificial Sequence
  Synthetic
aacgaggcgcactaagagcgca

SEQ ID NO: 3009 - DNA, 24 bp, Artificial Sequence
  Synthetic
gcctttgacagggaaagtttctca

SEQ ID NO: 3010 - DNA, 12 bp, Artificial Sequence
  Synthetic
cgcacccgctgg

SEQ ID NO: 3011 - DNA, 16 bp, Artificial Sequence
  Synthetic
tgcgctcttagtgcgc

SEQ ID NO: 3012 - DNA, 20 bp, Artificial Sequence
  Synthetic
aacgaggcgcactcggacgg

SEQ ID NO: 3013 - DNA, 20 bp, Artificial Sequence
  Synthetic
gtagccataaggtccgctca

SEQ ID NO: 3014 - DNA, 17 bp, Artificial Sequence
  Synthetic
gaggaacgaggcgttga

SEQ ID NO: 3015 - DNA, 14 bp, Artificial Sequence
  Synthetic
ccgtccgagtgcgc

SEQ ID NO: 3016 - DNA, 22 bp, Artificial Sequence
  Synthetic
ccgtcacgcctcctcggacggg

SEQ ID NO: 3017 - DNA, 25 bp, Artificial Sequence
  Synthetic
gttactgtagccataaggtccgcta

SEQ ID NO: 3018 - DNA, 16 bp, Artificial Sequence
  Synthetic
tggttcgaggcgttga

SEQ ID NO: 3019 - DNA, 15 bp, Artificial Sequence
  Synthetic
cccgtccgaggaggc

SEQ ID NO: 3020 - DNA, 22 bp, Artificial Sequence
  Synthetic
ccgtcacgcctcaaggtccgct

SEQ ID NO: 3021 - DNA, 24 bp, Artificial Sequence
  Synthetic
gatcttggggttactgtagccatc

SEQ ID NO: 3022 - DNA, 16 bp, Artificial Sequence
  Synthetic
ctcggacgggaggaac

SEQ ID NO: 3023 - DNA, 14 bp, Artificial Sequence
  Synthetic
agcggaccttgagg

SEQ ID NO: 3024 - DNA, 23 bp, Artificial Sequence
  Synthetic
aacgaggcgcacctgtcgttgag

SEQ ID NO: 3025 - DNA, 19 bp, Artificial Sequence
  Synthetic
caggacttgggcgagctga

SEQ ID NO: 3026 - DNA, 15 bp, Artificial Sequence
  Synthetic
agggtaggggaagac

SEQ ID NO: 3027 - DNA, 17 bp, Artificial Sequence
  Synthetic
ctcaacgacaggtgcgc

SEQ ID NO: 3028 - DNA, 21 bp, Artificial Sequence
  Synthetic
ccgtcacgcctccggcaaggg

SEQ ID NO: 3029 - DNA, 26 bp, Artificial Sequence
  Synthetic
tgctatgggcaaagtttcgtggatga

SEQ ID NO: 3030 - DNA, 13 bp, Artificial Sequence
  Synthetic
ttgcggaccgctg

SEQ ID NO: 3031 - DNA, 14 bp, Artificial Sequence
  Synthetic
cccttgccggaggc

SEQ ID NO: 3032 - DNA, 23 bp, Artificial Sequence
  Synthetic
ccgtcacgcctccgggtgttgta

SEQ ID NO: 3033 - DNA, 19 bp, Artificial Sequence
  Synthetic
gagagtcgcgtccttgcta

SEQ ID NO: 3034 - DNA, 16 bp, Artificial Sequence
  Synthetic
agttccagtgcaaagt

SEQ ID NO: 3035 - DNA, 16 bp, Artificial Sequence
  Synthetic
tacaacacccggaggc

SEQ ID NO: 3036 - DNA, 24 bp, Artificial Sequence
  Synthetic
ccgtcacgcctcttgtgctgatgt

SEQ ID NO: 3037 - DNA, 19 bp, Artificial Sequence
  Synthetic
gagggaggcgctgcgtaga

SEQ ID NO: 3038 - DNA, 15 bp, Artificial Sequence
  Synthetic
gtggagacgtggcac

SEQ ID NO: 3039 - DNA, 17 bp, Artificial Sequence
  Synthetic
acatcagcacaagaggc

SEQ ID NO: 3040 - DNA, 21 bp, Artificial Sequence
  Synthetic
aacgaggcgcactcgaggtca

SEQ ID NO: 3041 - DNA, 19 bp, Artificial Sequence
  Synthetic
ggctgcaccgagtcgtaga

SEQ ID NO: 3042 - DNA, 18 bp, Artificial Sequence
  Synthetic
tagttcctgttggtgaag

SEQ ID NO: 3043 - DNA, 15 bp, Artificial Sequence
  Synthetic
tgacctcgagtgcgc

SEQ ID NO: 3044 - DNA, 20 bp, Artificial Sequence
  Synthetic
aacgaggcgcacatgcggca

SEQ ID NO: 3045 - DNA, 23 bp, Artificial Sequence
  Synthetic
tgctatgggcaaagtttcgtggc

SEQ ID NO: 3046 - DNA, 14 bp, Artificial Sequence
  Synthetic
agggttgcggaccg

SEQ ID NO: 3047 - DNA, 14 bp, Artificial Sequence
  Synthetic
tgccgcatgtgcgc

SEQ ID NO: 3048 - DNA, 21 bp, Artificial Sequence
  Synthetic
aacgaggcgcacctgctggtg

SEQ ID NO: 3049 - DNA, 19 bp, Artificial Sequence
  Synthetic
tgttcctcctcagagtcga

SEQ ID NO: 3050 - DNA, 13 bp, Artificial Sequence
  Synthetic
gtgggcggtgtct

SEQ ID NO: 3051 - DNA, 15 bp, Artificial Sequence
  Synthetic
caccagcaggtgcgc

SEQ ID NO: 3052 - DNA, 21 bp, Artificial Sequence
  Synthetic
aacgaggcgcacccagtgggc

SEQ ID NO: 3053 - DNA, 19 bp, Artificial Sequence
  Synthetic
cgtggcacctcttgaggaa

SEQ ID NO: 3054 - DNA, 16 bp, Artificial Sequence
  Synthetic
tgtgaggaggtttgct

SEQ ID NO: 3055 - DNA, 14 bp, Artificial Sequence
  Synthetic
cccactgggtgcgc

SEQ ID NO: 3056 - DNA, 14 bp, Artificial Sequence
  Synthetic
  misc_feature (3)..(3): The residue at this position is linked to a Z28 quenching group.
ctcttctcagtgcg

SEQ ID NO: 3057 - DNA, 29 bp, Artificial Sequence
  Synthetic
cgcagtgagaatgaggtgatctcggcggt

SEQ ID NO: 3058 - DNA, 32 bp, Artificial Sequence
  Synthetic
ccgccgagatcacgtagttgaggtcaatgaag

SEQ ID NO: 3059 - DNA, 28 bp, Artificial Sequence
  Synthetic
ggaatcatattggaacatgtaaaccatc

SEQ ID NO: 3060 - DNA, 26 bp, Artificial Sequence
  Synthetic
cttcattgacctcaactacgtgatct

SEQ ID NO: 3061 - DNA, 28 bp, Artificial Sequence
  Synthetic
agaatcatactggaacatgtagaccatc

SEQ ID NO: 3062 - DNA, 28 bp, Artificial Sequence
  Synthetic
ggagtcatactggaacatgtagaccatc

SEQ ID NO: 3063 - DNA, 23 bp, Artificial Sequence
  Synthetic
ccgccgagatcacccatcccact

SEQ ID NO: 3064 - DNA, 33 bp, Artificial Sequence
  Synthetic
catctcgttttctctttattgtggtcgacttta

SEQ ID NO: 3065 - DNA, 14 bp, Artificial Sequence
  Synthetic
tctgcacctgcacc

SEQ ID NO: 3066 - DNA, 15 bp, Artificial Sequence
  Synthetic
gtgggatgggtgatc

SEQ ID NO: 3067 - DNA, 22 bp, Artificial Sequence
  Synthetic
ccgccgagatcacccatcccac

SEQ ID NO: 3068 - DNA, 28 bp, Artificial Sequence
  Synthetic
cgttttctctttattgtggtcgacttta

SEQ ID NO: 3069 - DNA, 14 bp, Artificial Sequence
  Synthetic
ttctgcacctgcac

SEQ ID NO: 3070 - DNA, 23 bp, Artificial Sequence
  Synthetic
ccgccgagatcaccttctgcacc

SEQ ID NO: 3071 - DNA, 28 bp, Artificial Sequence
  Synthetic
ctttattgtggtcgactttccatcccaa

SEQ ID NO: 3072 - DNA, 12 bp, Artificial Sequence
  Synthetic
tgcaccagggcc

SEQ ID NO: 3073 - DNA, 16 bp, Artificial Sequence
  Synthetic
ggtgcagaaggtgatc

SEQ ID NO: 3074 - DNA, 22 bp, Artificial Sequence
  Synthetic
ccgccgagatcaccaccagggc

SEQ ID NO: 3075 - DNA, 21 bp, Artificial Sequence
  Synthetic
ccatcccacttctgcacctga

SEQ ID NO: 3076 - DNA, 13 bp, Artificial Sequence
  Synthetic
cccgccatctagg

SEQ ID NO: 3077 - DNA, 14 bp, Artificial Sequence
  Synthetic
ccctggtggtgatc

SEQ ID NO: 3078 - DNA, 24 bp, Artificial Sequence
  Synthetic
ccgccgagatcaccgaattccacg

SEQ ID NO: 3079 - DNA, 25 bp, Artificial Sequence
  Synthetic
tcctgtcgtctgcggtgatttcata

SEQ ID NO: 3080 - DNA, 19 bp, Artificial Sequence
  Synthetic
cccagtttgaaggaaatct

SEQ ID NO: 3081 - DNA, 17 bp, Artificial Sequence
  Synthetic
cgtggaattcggtgatc

SEQ ID NO: 3082 - DNA, 25 bp, Artificial Sequence
  Synthetic
ccgccgagatcaccgaattccacgc

SEQ ID NO: 3083 - DNA, 20 bp, Artificial Sequence
  Synthetic
ccagtttgaaggaaatctcg

SEQ ID NO: 3084 - DNA, 27 bp, Artificial Sequence
  Synthetic
ccgccgagatcaccatcgaattccacg

SEQ ID NO: 3085 - DNA, 24 bp, Artificial Sequence
  Synthetic
cttcctgtcgtctgcggtgattta

SEQ ID NO: 3086 - DNA, 19 bp, Artificial Sequence
  Synthetic
cccagtttgaaggaaatct

SEQ ID NO: 3087 - DNA, 19 bp, Artificial Sequence
  Synthetic
gtggaattcgatggtgatc

SEQ ID NO: 3088 - DNA, 26 bp, Artificial Sequence
  Synthetic
ccgccgagatcacccgaacttccgcg

SEQ ID NO: 3089 - DNA, 20 bp, Artificial Sequence
  Synthetic
gcaagagcgagaaccctgga

SEQ ID NO: 3090 - DNA, 19 bp, Artificial Sequence
  Synthetic
cgcggaagttcgggtgatc

SEQ ID NO: 3091 - DNA, 28 bp, Artificial Sequence
  Synthetic
ccgccgagatcacgcaagagcgagaacc

SEQ ID NO: 3092 - DNA, 20 bp, Artificial Sequence
  Synthetic
ggcggttagagcagacgcgc

SEQ ID NO: 3093 - DNA, 21 bp, Artificial Sequence
  Synthetic
ggttctcgctcttgcgtgatc

SEQ ID NO: 3094 - DNA, 26 bp, Artificial Sequence
  Synthetic
ccgccgagatcacgcctatgtccttc

SEQ ID NO: 3095 - DNA, 28 bp, Artificial Sequence
  Synthetic
tcaggtcgcttagtccaacttaatgaac

SEQ ID NO: 3096 - DNA, 19 bp, Artificial Sequence
  Synthetic
gaaggacataggcgtgatc

SEQ ID NO: 3097 - DNA, 25 bp, Artificial Sequence
  Synthetic
ccgccgagatcacgtcgcttagtcc

SEQ ID NO: 3098 - DNA, 27 bp, Artificial Sequence
  Synthetic
ggtagacagtcgaatcatccattcagc

SEQ ID NO: 3099 - DNA, 18 bp, Artificial Sequence
  Synthetic
ggactaagcgacgtgatc

SEQ ID NO: 3100 - DNA, 25 bp, Artificial Sequence
  Synthetic
ccgccgagatcacgcctatgtcctt

SEQ ID NO: 3101 - DNA, 26 bp, Artificial Sequence
  Synthetic
aggtcgcttagtccaacttaatgaac

SEQ ID NO: 3102 - DNA, 23 bp, Artificial Sequence
  Synthetic
cgcgtactgacggaagcactgtc

SEQ ID NO: 3103 - DNA, 18 bp, Artificial Sequence
  Synthetic
aaggacataggcgtgatc

SEQ ID NO: 3104 - DNA, 27 bp, Artificial Sequence
  Synthetic
ccgccgagatcacgcttccgatgtact

SEQ ID NO: 3105 - DNA, 34 bp, Artificial Sequence
  Synthetic
gcatgtaatctgcaacattctggcccatgatgta

SEQ ID NO: 3106 - DNA, 39 bp, Artificial Sequence
  Synthetic
tctgcattaaattccttgctttcagaatcataaccaggg

SEQ ID NO: 3107 - DNA, 20 bp, Artificial Sequence
  Synthetic
agtacatcggaagcgtgatc

SEQ ID NO: 3108 - DNA, 21 bp, Artificial Sequence
  Synthetic
ccgccgagatcacgcttccga

SEQ ID NO: 3109 - DNA, 22 bp, Artificial Sequence
  Synthetic
gcaacattctggcccatgatgt

SEQ ID NO: 3110 - DNA, 22 bp, Artificial Sequence
  Synthetic
tgtacttctgcattaaattcct

SEQ ID NO: 3111 - DNA, 14 bp, Artificial Sequence
  Synthetic
tcggaagcgtgatc

SEQ ID NO: 3112 - DNA, 26 bp, Artificial Sequence
  Synthetic
ccgccgagatcactgggtcatcttct

SEQ ID NO: 3113 - DNA, 27 bp, Artificial Sequence
  Synthetic
gggtgttgaaggtctcaaacatgatca

SEQ ID NO: 3114 - DNA, 19 bp, Artificial Sequence
  Synthetic
agaagatgacccagtgatc

SEQ ID NO: 3115 - DNA, 24 bp, Artificial Sequence
  Synthetic
ccgccgagatcacagcagccgtgg

SEQ ID NO: 3116 - DNA, 17 bp, Artificial Sequence
  Synthetic
ccagggaggagctggac

SEQ ID NO: 3117 - DNA, 17 bp, Artificial Sequence
  Synthetic
ccacggctgctgtgatc

SEQ ID NO: 3118 - DNA, 26 bp, Artificial Sequence
  Synthetic
ccgccgagatcactgggtcatctttt

SEQ ID NO: 3119 - DNA, 27 bp, Artificial Sequence
  Synthetic
gggtgttgaaggtctcaaacatgatca

SEQ ID NO: 3120 - DNA, 19 bp, Artificial Sequence
  Synthetic
aaaagatgacccagtgatc

SEQ ID NO: 3121 - DNA, 22 bp, Artificial Sequence
  Synthetic
ccgccgagatcactgggtcatc

SEQ ID NO: 3122 - DNA, 27 bp, Artificial Sequence
  Synthetic
gggtgttgaaggtctcaaacatgatca

SEQ ID NO: 3123 - DNA, 15 bp, Artificial Sequence
  Synthetic
ttttcacggttggcc

SEQ ID NO: 3124 - DNA, 15 bp, Artificial Sequence
  Synthetic
gatgacccagtgatc

SEQ ID NO: 3125 - DNA, 24 bp, Artificial Sequence
  Synthetic
ccgccgagatcacatagctcttca

SEQ ID NO: 3126 - DNA, 23 bp, Artificial Sequence
  Synthetic
cccctgttgactggtcattacac

SEQ ID NO: 3127 - DNA, 25 bp, Artificial Sequence
  Synthetic
gtctgataaaatctacagtcatagg

SEQ ID NO: 3128 - DNA, 17 bp, Artificial Sequence
  Synthetic
tgaagagctatgtgatc

SEQ ID NO: 3129 - DNA, 27 bp, Artificial Sequence
  Synthetic
ccgccgagatcactttgaacaagttgg

SEQ ID NO: 3130 - DNA, 33 bp, Artificial Sequence
  Synthetic
gggaactgctgacaaagattcactggtaataaa

SEQ ID NO: 3131 - DNA, 31 bp, Artificial Sequence
  Synthetic
aaaatacagtcaacattactgaaacactact

SEQ ID NO: 3132 - DNA, 20 bp, Artificial Sequence
  Synthetic
ccaacttgttcaaagtgatc

SEQ ID NO: 3133 - DNA, 23 bp, Artificial Sequence
  Synthetic
ccgccgagatcacctggttgttt

SEQ ID NO: 3134 - DNA, 20 bp, Artificial Sequence
  Synthetic
ggacagcagccttaatccta

SEQ ID NO: 3135 - DNA, 19 bp, Artificial Sequence
  Synthetic
gttatctggttgttcttca

SEQ ID NO: 3136 - DNA, 16 bp, Artificial Sequence
  Synthetic
aaacaaccaggtgatc

SEQ ID NO: 3137 - DNA, 21 bp, Artificial Sequence
  Synthetic
ccgccgagatcacaccgactt

SEQ ID NO: 3138 - DNA, 22 bp, Artificial Sequence
  Synthetic
cctaggtggctcataaggactc

SEQ ID NO: 3139 - DNA, 14 bp, Artificial Sequence
  Synthetic
ggctccattgtcca

SEQ ID NO: 3140 - DNA, 14 bp, Artificial Sequence
  Synthetic
aagtcggtgtgatc

SEQ ID NO: 3141 - DNA, 21 bp, Artificial Sequence
  Synthetic
ccgccgagatcaccccatcca

SEQ ID NO: 3142 - DNA, 22 bp, Artificial Sequence
  Synthetic
ctttcaggaccacagtccaaga

SEQ ID NO: 3143 - DNA, 14 bp, Artificial Sequence
  Synthetic
gccagcaggtatgc

SEQ ID NO: 3144 - DNA, 14 bp, Artificial Sequence
  Synthetic
tggatggggtgatc

SEQ ID NO: 3145 - DNA, 22 bp, Artificial Sequence
  Synthetic
ccgccgagatcaccttccttgg

SEQ ID NO: 3146 - DNA, 21 bp, Artificial Sequence
  Synthetic
ctcttcacggcgcttgcgtga

SEQ ID NO: 3147 - DNA, 17 bp, Artificial Sequence
  Synthetic
tcttagacctgcgagcc

SEQ ID NO: 3148 - DNA, 15 bp, Artificial Sequence
  Synthetic
ccaaggaaggtgatc

SEQ ID NO: 3149 - DNA, 18 bp, Artificial Sequence
  Synthetic
ctcccggcgctttcgtga

SEQ ID NO: 3150 - DNA, 17 bp, Artificial Sequence
  Synthetic
tcttagacctgcgagcc

SEQ ID NO: 3151 - DNA, 23 bp, Artificial Sequence
  Synthetic
ccgccgagatcactgcttccttg

SEQ ID NO: 3152 - DNA, 20 bp, Artificial Sequence
  Synthetic
gctcttcacggcgcttgcga

SEQ ID NO: 3153 - DNA, 18 bp, Artificial Sequence
  Synthetic
gtcttagacctgcgagcc

SEQ ID NO: 3154 - DNA, 16 bp, Artificial Sequence
  Synthetic
caaggaagcagtgatc

SEQ ID NO: 3155 - DNA, 17 bp, Artificial Sequence
  Synthetic
cctcccggcgctttcga

SEQ ID NO: 3156 - DNA, 22 bp, Artificial Sequence
  Synthetic
agcctcaagatcatcgtgatct

SEQ ID NO: 3157 - DNA, 14 bp, Artificial Sequence
  Synthetic
  misc_feature (3)..(3): The residue at this position is linked to a Z28 quenching group.
ctcttctcagtgcg

SEQ ID NO: 3158 - DNA, 13 bp, Artificial Sequence
  Synthetic
  misc_feature (3)..(3): The residue at this position is linked to a Z28 quenching group.
cactgcttcgtgg

SEQ ID NO: 3159 - DNA, 28 bp, Artificial Sequence
  Synthetic
ccaggaagcaagtggtgatctcggcggt

SEQ ID NO: 3160 - DNA, 14 bp, Artificial Sequence
  Synthetic
  misc_feature (3)..(3): The residue at this position is linked to a Z28 quenching group.
ctcttctcagtgcg

SEQ ID NO: 3161 - DNA, 14 bp, Artificial Sequence
  Synthetic
  misc_feature (3)..(3): The residue at this position is linked to a Z28 quenching group.
ctcttctcagtgcg

SEQ ID NO: 3162 - DNA, 13 bp, Artificial Sequence
  Synthetic
  misc_feature (3)..(3): The residue at this position is linked to a Z28 quenching group.
tccactccgagct

SEQ ID NO: 3163 - DNA, 13 bp, Artificial Sequence
  Synthetic
  misc_feature (3)..(3): The residue at this position is linked to a Z28 quenching group.
tccactccgagct

SEQ ID NO: 3164 - DNA, 27 bp, Artificial Sequence
  Synthetic
agctcggagtaggagtgcgcctcgttt

SEQ ID NO: 3165 - DNA, 27 bp, Artificial Sequence
  Synthetic
agcacggagtaggagtgcgcctcgttt

SEQ ID NO: 3166 - DNA, 27 bp, Artificial Sequence
  Synthetic
agcccggagtaggagtgcgcctcgttt

SEQ ID NO: 3167 - DNA, 27 bp, Artificial Sequence
  Synthetic
agcgcggagtaggagtgcgcctcgttt

SEQ ID NO: 3168 - DNA, 27 bp, Artificial Sequence
  Synthetic
agcgcggagtaggagtgcgcctcgttt

SEQ ID NO: 3169 - DNA, 27 bp, Artificial Sequence
  Synthetic
  modified_base (3)..(3): The residue at this position is a30.
ccaggaagcaagtggtgcgcctcgttt

SEQ ID NO: 3170 - DNA, 27 bp, Artificial Sequence
  Synthetic
  modified_base (3)..(3): The residue at this position is a30.
  modified_base (26)..(26): The residue at this position is u33.
ccaggaagcaagtggtgcgcctcgtut

SEQ ID NO: 3171 - DNA, 27 bp, Artificial Sequence
  Synthetic
  modified_base (3)..(3): The residue at this position is a30.
  modified_base (6)..(6): The residue at this position is a30.
  modified_base (26)..(26): The residue at this position is u33.
ccaggaagcaagtggtgcgcctcgtut

SEQ ID NO: 3172 - DNA, 27 bp, Artificial Sequence
  Synthetic
  modified_base (3)..(3): The residue at this position is a30.
  modified_base (6)..(6): The residue at this position is a30.
  modified_base (7)..(7): The residue at this position is a30.
  modified_base (26)..(26): The residue at this position is u33.
ccaggaagcaagtggtgcgcctcgtut

SEQ ID NO: 3173 - DNA, 27 bp, Artificial Sequence
  Synthetic
  modified_base (3)..(3): The residue at this position is a30.
  modified_base (6)..(6): The residue at this position is a30.
  modified_base (7)..(7): The residue at this position is a30.
  modified_base (10)..(10): The residue at this position is a30.
  modified_base (26)..(26): The residue at this position is u33.
ccaggaagcaagtggtgcgcctcgtut

SEQ ID NO: 3174 - DNA, 27 bp, Artificial Sequence
  Synthetic
  modified_base (3)..(3): The residue at this position is a30.
  modified_base (6)..(6): The residue at this position is a30.
  modified_base (7)..(7): The residue at this position is a30.
  modified_base (10)..(10): The residue at this position is a30.
  modified_base (11)..(11): The residue at this position is a30.
  modified_base (26)..(26): The residue at this position is u33.
ccaggaagcaagtggtgcgcctcgtut

SEQ ID NO: 3175 - DNA, 13 bp, Artificial Sequence
  Synthetic
  misc_feature (3)..(3): The residue at this position is linked to a Z28 quenching group.
cactgcttcgtgg

SEQ ID NO: 3176 - DNA, 27 bp, Artificial Sequence
  Synthetic
ccaggaagcaagtggtgcgcctcgttt

SEQ ID NO: 3177 - DNA, 27 bp, Artificial Sequence
  Synthetic
ccaggaagcaagtggaggcgtgacggt

SEQ ID NO: 3178 - DNA, 20 bp, Artificial Sequence
  Synthetic
ccgtcacgcctcgccccaca

SEQ ID NO: 3179 - DNA, 25 bp, Artificial Sequence
  Synthetic
cttttccatactttttatgacattc

SEQ ID NO: 3180 - DNA, 14 bp, Artificial Sequence
  Synthetic
tgtggggcgaggcg

SEQ ID NO: 3181 - DNA, 14 bp, Artificial Sequence
  Synthetic
tgtggggcgaggcg

SEQ ID NO: 3182 - DNA, 25 bp, Artificial Sequence
  Synthetic
ccgtcacgcctcatggataatgccc

SEQ ID NO: 3183 - DNA, 22 bp, Artificial Sequence
  Synthetic
cagaggaaagagagctgcaggg

SEQ ID NO: 3184 - DNA, 19 bp, Artificial Sequence
  Synthetic
gggcattatccatgaggcg

SEQ ID NO: 3185 - DNA, 19 bp, Artificial Sequence
  Synthetic
gggcattatccatgaggcg

SEQ ID NO: 3186 - DNA, 20 bp, Artificial Sequence
  Synthetic
gcagaaaacagtccgtgcgc

SEQ ID NO: 3187 - DNA, 24 bp, Artificial Sequence
  Synthetic
ccgtcacgcctcagagccaatcac

SEQ ID NO: 3188 - DNA, 31 bp, Artificial Sequence; identical to SEQ ID NO: 681
  Synthetic

SEQ ID NO: 3189 - DNA, 18 bp, Artificial Sequence
  Synthetic
gtgattggctctgaggcg

SEQ ID NO: 3190 - DNA, 18 bp, Artificial Sequence
  Synthetic
gtgattggctctgaggcg

SEQ ID NO: 3191 - DNA, 23 bp, Artificial Sequence
  Synthetic
ccgtcacgcctccaccatatccc

SEQ ID NO: 3192 - DNA, 21 bp, Artificial Sequence
  Synthetic
cggaagaatgggtcgaccatg

SEQ ID NO: 3193 - DNA, 17 bp, Artificial Sequence
  Synthetic
gggatatggtggaggcg

SEQ ID NO: 3194 - DNA, 17 bp, Artificial Sequence
  Synthetic
gggatatggtggaggcg

SEQ ID NO: 3195 - DNA, 30 bp, Artificial Sequence; identical to SEQ ID NO: 1460
  Synthetic

SEQ ID NO: 3196 - DNA, 18 bp, Artificial Sequence
  Synthetic
ggactctgtcaagtgcgc

SEQ ID NO: 3197 - DNA, 22 bp, Artificial Sequence
  Synthetic
aacgaggcgcacgcaactcgca

SEQ ID NO: 3198 - DNA, 22 bp, Artificial Sequence
  Synthetic
aacgaggcgcacgcaactcgca

SEQ ID NO: 3199 - DNA, 22 bp, Artificial Sequence
  Synthetic
aacgaggcgcacgcaactcgca

SEQ ID NO: 3200 - DNA, 22 bp, Artificial Sequence
  Synthetic
aacgaggcgcacgcaactcgca

SEQ ID NO: 3201 - DNA, 22 bp, Artificial Sequence
  Synthetic
aacgaggcgcacgcaactcgca

SEQ ID NO: 3202 - DNA, 22 bp, Artificial Sequence
  Synthetic
aacgaggcgcacgcaactcgca

SEQ ID NO: 3203 - DNA, 22 bp, Artificial Sequence
  Synthetic
aacgaggcgcacgcaactcgca

SEQ ID NO: 3204 - DNA, 18 bp, Artificial Sequence
  Synthetic
ggcctgcagagactctgc

SEQ ID NO: 3205 - DNA, 15 bp, Artificial Sequence
  Synthetic
gccactgctaagcac

SEQ ID NO: 3206 - DNA, 16 bp, Artificial Sequence
  Synthetic
tgcgagttgcgtgcgc

SEQ ID NO: 3207 - DNA, 23 bp, Artificial Sequence
  Synthetic
aacgaggcgcacctccaatctca

SEQ ID NO: 3208 - DNA, 23 bp, Artificial Sequence
  Synthetic
aacgaggcgcacctccaatctca

SEQ ID NO: 3209 - DNA, 23 bp, Artificial Sequence
  Synthetic
aacgaggcgcacctccaatctca

SEQ ID NO: 3210 - DNA, 23 bp, Artificial Sequence
  Synthetic
aacgaggcgcacctccaatctca

SEQ ID NO: 3211 - DNA, 23 bp, Artificial Sequence
  Synthetic
aacgaggcgcacctccaatctca

SEQ ID NO: 3212 - DNA, 23 bp, Artificial Sequence
  Synthetic
aacgaggcgcacctccaatctca

SEQ ID NO: 3213 - DNA, 23 bp, Artificial Sequence
  Synthetic
aacgaggcgcacctccaatctca

SEQ ID NO: 3214 - DNA, 26 bp, Artificial Sequence
  Synthetic
cccccactaagatttatacccttcta

SEQ ID NO: 3215 - DNA, 15 bp, Artificial Sequence
  Synthetic
gccaaatctcctcca

SEQ ID NO: 3216 - DNA, 17 bp, Artificial Sequence
  Synthetic
tgagattggaggtgcgc

SEQ ID NO: 3217 - DNA, 13 bp, Artificial Sequence
  Synthetic
  misc_feature (3)..(3): The residue at this position is linked to a Z28 quenching group.
cactgcttcgtgg

SEQ ID NO: 3218 - DNA, 27 bp, Artificial Sequence
  Synthetic
ccaggaagcaagtggtgcgcctcgttt

SEQ ID NO: 3219 - DNA, 27 bp, Artificial Sequence
  Synthetic
ccaggaagcaagtggaggcgtgacggt

SEQ ID NO: 3220 - DNA, 27 bp, Artificial Sequence
  Synthetic
ccaggaagcaagtgacgcagcgacggt

SEQ ID NO: 3221 - DNA, 22 bp, Artificial Sequence
  Synthetic
aacgaggcgcaccaccatatcc

SEQ ID NO: 3222 - DNA, 22 bp, Artificial Sequence
  Synthetic
ccggaagaatgggtcgaccatg

SEQ ID NO: 3223 - DNA, 16 bp, Artificial Sequence
  Synthetic
ggatatggtggtgcgc

SEQ ID NO: 3224 - DNA, 18 bp, Artificial Sequence
  Synthetic
ccggaagaatgggtcgac

SEQ ID NO: 3225 - DNA, 23 bp, Artificial Sequence
  Synthetic
ccgtcacgcctcggttgaggttc

SEQ ID NO: 3226 - DNA, 20 bp, Artificial Sequence
  Synthetic
tggtggctgaattcactgtg

SEQ ID NO: 3227 - DNA, 17 bp, Artificial Sequence
  Synthetic
gaacctcaaccgaggcg

SEQ ID NO: 3228 - DNA, 17 bp, Artificial Sequence
  Synthetic
tggtggctgaattcact

SEQ ID NO: 3229 - DNA, 22 bp, Artificial Sequence
  Synthetic
ccgtcacgcctcggttgaggtt

SEQ ID NO: 3230 - DNA, 21 bp, Artificial Sequence
  Synthetic
ctggtggctgaattcactgtg

SEQ ID NO: 3231 - DNA, 16 bp, Artificial Sequence
  Synthetic
aacctcaaccgaggcg

SEQ ID NO: 3232 - DNA, 17 bp, Artificial Sequence
  Synthetic
ctggtggctgaattcac

SEQ ID NO: 3233 - DNA, 20 bp, Artificial Sequence
  Synthetic
aacgaggcgcaccgagccca

SEQ ID NO: 3234 - DNA, 20 bp, Artificial Sequence
  Synthetic
gcatcaccaccatgcgctga

SEQ ID NO: 3235 - DNA, 18 bp, Artificial Sequence
  Synthetic
cgtacagcgtgaacaccg

SEQ ID NO: 3236 - DNA, 20 bp, Artificial Sequence
  Synthetic
gcatcaccaccatgcgctga

SEQ ID NO: 3237 - DNA, 21 bp, Artificial Sequence
  Synthetic
aacgaggcgcaccctgagtgc

SEQ ID NO: 3238 - DNA, 17 bp, Artificial Sequence
  Synthetic
gctggccttgggtctta

SEQ ID NO: 3239 - DNA, 15 bp, Artificial Sequence
  Synthetic
ttccagcaggaagtg

SEQ ID NO: 3240 - DNA, 15 bp, Artificial Sequence
  Synthetic
gcactcagggtgcgc

SEQ ID NO: 3241 - DNA, 21 bp, Artificial Sequence
  Synthetic
aacgaggcgcacccacgagca

SEQ ID NO: 3242 - DNA, 23 bp, Artificial Sequence
  Synthetic
ctgtgcttttccttctccattta

SEQ ID NO: 3243 - DNA, 14 bp, Artificial Sequence
  Synthetic
ggcagtcggtgagg

SEQ ID NO: 3244 - DNA, 15 bp, Artificial Sequence
  Synthetic
tgctcgtgggtgcgc

SEQ ID NO: 3245 - DNA, 22 bp, Artificial Sequence
  Synthetic
aacgaggcgcacttggcactac

SEQ ID NO: 3246 - DNA, 28 bp, Artificial Sequence
  Synthetic
ggttgtcatacaaaacagagtccagaga

SEQ ID NO: 3247 - DNA, 24 bp, Artificial Sequence
  Synthetic
gtcatacaaaacagagtccagaga

SEQ ID NO: 3248 - DNA, 14 bp, Artificial Sequence
  Synthetic
gactgtgcccttgg

SEQ ID NO: 3249 - DNA, 16 bp, Artificial Sequence
  Synthetic
gtagtgccaagtgcgc

SEQ ID NO: 3250 - DNA, 23 bp, Artificial Sequence
  Synthetic
aacgaggcgcacttggcaggaca

SEQ ID NO: 3251 - DNA, 29 bp, Artificial Sequence
  Synthetic
gctacagaaatgagggcaaaaagatgaga

SEQ ID NO: 3252 - DNA, 16 bp, Artificial Sequence
  Synthetic
ctcagcagaaggatgg

SEQ ID NO: 3253 - DNA, 17 bp, Artificial Sequence
  Synthetic
tgtcctgccaagtgcgc

SEQ ID NO: 3254 - DNA, 15 bp, Artificial Sequence
  Synthetic
ctcagcagaggatgg

SEQ ID NO: 3255 - DNA, 23 bp, Artificial Sequence
  Synthetic
ccgtcacgcctcttggcaggaca

SEQ ID NO: 3256 - DNA, 17 bp, Artificial Sequence
  Synthetic
tgtcctgccaagaggcg

SEQ ID NO: 3257 - DNA, 22 bp, Artificial Sequence
  Synthetic
aacgaggcgcacttggcaggac

SEQ ID NO: 3258 - DNA, 17 bp, Artificial Sequence
  Synthetic
actcagcagaaggatgg

SEQ ID NO: 3259 - DNA, 16 bp, Artificial Sequence
  Synthetic
gtcctgccaagtgcgc

SEQ ID NO: 3260 - DNA, 21 bp, Artificial Sequence
  Synthetic
aacgaggcgcacttggcagga

SEQ ID NO: 3261 - DNA, 18 bp, Artificial Sequence
  Synthetic
cactcagcagaaggatgg

SEQ ID NO: 3262 - DNA, 15 bp, Artificial Sequence
  Synthetic
tcctgccaagtgcgc

SEQ ID NO: 3263 - DNA, 22 bp, Artificial Sequence
  Synthetic
aacgaggcgcacccgattgtcc

SEQ ID NO: 3264 - DNA, 30 bp, Artificial Sequence
  Synthetic
gatttctaagaacattttaattcatgatga

SEQ ID NO: 3265 - DNA, 21 bp, Artificial Sequence
  Synthetic
caagactctgagaactgaagg

SEQ ID NO: 3266 - DNA, 16 bp, Artificial Sequence
  Synthetic
ggacaatcgggtgcgc

SEQ ID NO: 3267 - DNA, 22 bp, Artificial Sequence
  Synthetic
ccgtcacgcctcccgattgtcc

SEQ ID NO: 3268 - DNA, 16 bp, Artificial Sequence
  Synthetic
ggacaatcgggaggcg

SEQ ID NO: 3269 - DNA, 28 bp, Artificial Sequence
  Synthetic
aacgaggcgcactactattatttcatag

SEQ ID NO: 3270 - DNA, 27 bp, Artificial Sequence
  Synthetic
catttctatctactgttctgcatcaga

SEQ ID NO: 3271 - DNA, 25 bp, Artificial Sequence
  Synthetic
aaaagatgaggcatacattaatttc

SEQ ID NO: 3272 - DNA, 22 bp, Artificial Sequence
  Synthetic
ctatgaaataatagtagtgcgc

SEQ ID NO: 3273 - DNA, 29 bp, Artificial Sequence
  Synthetic
aacgaggcgcactactattatttcataga

SEQ ID NO: 3274 - DNA, 24 bp, Artificial Sequence
  Synthetic
aaagatgaggcatacattaatttc

SEQ ID NO: 3275 - DNA, 23 bp, Artificial Sequence
  Synthetic
tctatgaaataatagtagtgcgc

SEQ ID NO: 3276 - DNA, 29 bp, Artificial Sequence
  Synthetic
ccgtcacgcctctactattatttcataga

SEQ ID NO: 3277 - DNA, 23 bp, Artificial Sequence
  Synthetic
tctatgaaataatagtagaggcg

SEQ ID NO: 3278 - DNA, 24 bp, Artificial Sequence
  Synthetic
aacgaggcgcacaggtgtctggag

SEQ ID NO: 3279 - DNA, 21 bp, Artificial Sequence
  Synthetic
ggtccacgcacaagctgggac

SEQ ID NO: 3280 - DNA, 22 bp, Artificial Sequence
  Synthetic
taaaagctacagaaatgagggc

SEQ ID NO: 3281 - DNA, 18 bp, Artificial Sequence
  Synthetic
ctccagacacctgtgcgc

SEQ ID NO: 3282 - DNA, 24 bp, Artificial Sequence
  Synthetic
ccgtcacgcctcaggtgtctggag

SEQ ID NO: 3283 - DNA, 18 bp, Artificial Sequence
  Synthetic
ctccagacacctgaggcg

SEQ ID NO: 3284 - DNA, 25 bp, Artificial Sequence
  Synthetic
aacgaggcgcacaggtgtctggagt

SEQ ID NO: 3285 - DNA, 21 bp, Artificial Sequence
  Synthetic
aaaagctacagaaatgagggc

SEQ ID NO: 3286 - DNA, 19 bp, Artificial Sequence
  Synthetic
actccagacacctgtgcgc

SEQ ID NO: 3287 - DNA, 23 bp, Artificial Sequence
  Synthetic
gagcaaacctcatgycaatrcac

SEQ ID NO: 3288 - DNA, 18 bp, Artificial Sequence
  Synthetic
tccattyccaaagggcag

SEQ ID NO: 3289 - DNA, 22 bp, Artificial Sequence
  Synthetic
aacgaggcgcacttttgctccc

SEQ ID NO: 3290 - DNA, 22 bp, Artificial Sequence
  Synthetic
ggtcatagagcaggactcgtga

SEQ ID NO: 3291 - DNA, 16 bp, Artificial Sequence
  Synthetic
tgagagccactgtaag

SEQ ID NO: 3292 - DNA, 16 bp, Artificial Sequence
  Synthetic
gggagcaaaagtgcgc

SEQ ID NO: 3293 - DNA, 22 bp, Artificial Sequence
  Synthetic
ccgtcacgcctcttttgctccc

SEQ ID NO: 3294 - DNA, 16 bp, Artificial Sequence
  Synthetic
gggagcaaaagaggcg

SEQ ID NO: 3295 - DNA, 25 bp, Artificial Sequence
  Synthetic
aacgaggcgcacgttgtgatacctt

SEQ ID NO: 3296 - DNA, 27 bp, Artificial Sequence
  Synthetic
gatgaaggccataaattaaaattgtgc

SEQ ID NO: 3297 - DNA, 16 bp, Artificial Sequence
  Synthetic
tgggtatggaacgtcc

SEQ ID NO: 3298 - DNA, 19 bp, Artificial Sequence
  Synthetic
aaggtatcacaacgtgcgc

SEQ ID NO: 3299 - DNA, 25 bp, Artificial Sequence
  Synthetic
ccgtcacgcctcgttgtgatacctt

SEQ ID NO: 3300 - DNA, 19 bp, Artificial Sequence
  Synthetic
aaggtatcacaacgaggcg

SEQ ID NO: 3301 - DNA, 25 bp, Artificial Sequence
  Synthetic
aacgaggcgcacttgtgataccttt

SEQ ID NO: 3302 - DNA, 28 bp, Artificial Sequence
  Synthetic
gatgaaggccataaattaaaattgtgga

SEQ ID NO: 3303 - DNA, 17 bp, Artificial Sequence
  Synthetic
gggtatggaacgtccat

SEQ ID NO: 3304 - DNA, 19 bp, Artificial Sequence
  Synthetic
aaaggtatcacaagtgcgc

SEQ ID NO: 3305 - DNA, 25 bp, Artificial Sequence
  Synthetic
ccgtcacgcctcttgtgataccttt

SEQ ID NO: 3306 - DNA, 19 bp, Artificial Sequence
  Synthetic
aaaggtatcacaagaggcg

SEQ ID NO: 3307 - DNA, 23 bp, Artificial Sequence
  Synthetic
aacgaggcgcacccatagggacc

SEQ ID NO: 3308 - DNA, 29 bp, Artificial Sequence
  Synthetic
ccattcttggacttcaacacaagtcttga

SEQ ID NO: 3309 - DNA, 13 bp, Artificial Sequence
  Synthetic
gggatcctggtgg

SEQ ID NO: 3310 - DNA, 17 bp, Artificial Sequence
  Synthetic
ggtccctatgggtgcgc

SEQ ID NO: 3311 - DNA, 23 bp, Artificial Sequence
  Synthetic
ccgtcacgcctcccatagggacc

SEQ ID NO: 3312 - DNA, 17 bp, Artificial Sequence
  Synthetic
ggtccctatgggaggcg

SEQ ID NO: 3313 - DNA, 24 bp, Artificial Sequence
  Synthetic
aacgaggcgcacatgacgggacac

SEQ ID NO: 3314 - DNA, 29 bp, Artificial Sequence
  Synthetic
gctacagaaatgagggcaaaaaaatgagc

SEQ ID NO: 3315 - DNA, 15 bp, Artificial Sequence
  Synthetic
tcagcagaggatggg

SEQ ID NO: 3316 - DNA, 18 bp, Artificial Sequence
  Synthetic
gtgtcccgtcatgtgcgc

SEQ ID NO: 3317 - DNA, 24 bp, Artificial Sequence
  Synthetic
ccgtcacgcctcatgacgggacac

SEQ ID NO: 3318 - DNA, 18 bp, Artificial Sequence
  Synthetic
gtgtcccgtcatgaggcg

SEQ ID NO: 3319 - DNA, 24 bp, Artificial Sequence
  Synthetic
aacgaggcgcactgactttctgtg

SEQ ID NO: 3320 - DNA, 27 bp, Artificial Sequence
  Synthetic
cgtcttttctccataataggctttgaa

SEQ ID NO: 3321 - DNA, 19 bp, Artificial Sequence
  Synthetic
atcagatgctgtctttggt

SEQ ID NO: 3322 - DNA, 18 bp, Artificial Sequence
  Synthetic
cacagaaagtcagtgcgc

SEQ ID NO: 3323 - DNA, 19 bp, Artificial Sequence
  Synthetic
gtcagatgctgtctttggt

SEQ ID NO: 3324 - DNA, 19 bp, Artificial Sequence
  Synthetic
ctaagatgctgtctttggt

SEQ ID NO: 3325 - DNA, 19 bp, Artificial Sequence
  Synthetic
ctgagatgctgtctttggt

SEQ ID NO: 3326 - DNA, 19 bp, Artificial Sequence
  Synthetic
atcagaggccgtctttggt

SEQ ID NO: 3327 - DNA, 17 bp, Artificial Sequence
  Synthetic
atcagaggccgtctttg

SEQ ID NO: 3328 - DNA, 21 bp, Artificial Sequence
  Synthetic
aacgaggcgcacccggttctc

SEQ ID NO: 3329 - DNA, 22 bp, Artificial Sequence
  Synthetic
gatctcctccgggtagaacgaa

SEQ ID NO: 3330 - DNA, 15 bp, Artificial Sequence
  Synthetic
gcccttgtagttcac

SEQ ID NO: 3331 - DNA, 15 bp, Artificial Sequence
  Synthetic
gagaaccgggtgcgc

SEQ ID NO: 3332 - DNA, 21 bp, Artificial Sequence
  Synthetic
aacgaggcgcacactcgaagc

SEQ ID NO: 3333 - DNA, 17 bp, Artificial Sequence
  Synthetic
ggcgggatgccgctcac

SEQ ID NO: 3334 - DNA, 11 bp, Artificial Sequence
  Synthetic
gccccagcagg

SEQ ID NO: 3335 - DNA, 15 bp, Artificial Sequence
  Synthetic
gcttcgagtgtgcgc

SEQ ID NO: 3336 - DNA, 21 bp, Artificial Sequence
  Synthetic
aacgaggcgcacggtacgcct

SEQ ID NO: 3337 - DNA, 15 bp, Artificial Sequence
  Synthetic
caccgggtggcccac

SEQ ID NO: 3338 - DNA, 15 bp, Artificial Sequence
  Synthetic
cggcgatctccttca

SEQ ID NO: 3339 - DNA, 15 bp, Artificial Sequence
  Synthetic
aggcgtaccgtgcgc

SEQ ID NO: 3340 - DNA, 22 bp, Artificial Sequence
  Synthetic
aacgaggcgcacggtacgcctc

SEQ ID NO: 3341 - DNA, 15 bp, Artificial Sequence
  Synthetic
ggcgatctccttcat

SEQ ID NO: 3342 - DNA, 16 bp, Artificial Sequence
  Synthetic
gaggcgtaccgtgcgc

SEQ ID NO: 3343 - DNA, 22 bp, Artificial Sequence
  Synthetic
ccgtcacgcctcggtacgcctc

SEQ ID NO: 3344 - DNA, 16 bp, Artificial Sequence
  Synthetic
gaggcgtaccgaggcg

SEQ ID NO: 3345 - DNA, 21 bp, Artificial Sequence
  Synthetic
aacgaggcgcacgtacgcctc

SEQ ID NO: 3346 - DNA, 15 bp, Artificial Sequence
  Synthetic
accgggtggcccagc

SEQ ID NO: 3347 - DNA, 15 bp, Artificial Sequence
  Synthetic
gaggcgtacgtgcgc

SEQ ID NO: 3348 - DNA, 21 bp, Artificial Sequence
  Synthetic
ccgtcgctgcgtgctcaactc

SEQ ID NO: 3349 - DNA, 15 bp, Artificial Sequence
  Synthetic
gccggcgggatgccc

SEQ ID NO: 3350 - DNA, 12 bp, Artificial Sequence
  Synthetic
gaagcgccccag

SEQ ID NO: 3351 - DNA, 16 bp, Artificial Sequence
  Synthetic
gagttgagcacgcagc

SEQ ID NO: 3352 - DNA, 22 bp, Artificial Sequence
  Synthetic
aacgaggcgcaccagcaccatg

SEQ ID NO: 3353 - DNA, 21 bp, Artificial Sequence
  Synthetic
gcgatctccttcatcttggta

SEQ ID NO: 3354 - DNA, 20 bp, Artificial Sequence
  Synthetic
cagtctccttcatcttggta

SEQ ID NO: 3355 - DNA, 21 bp, Artificial Sequence
  Synthetic
gcgatctccttcatcttggta

SEQ ID NO: 3356 - DNA, 16 bp, Artificial Sequence
  Synthetic
catggtgctggtgcgc

SEQ ID NO: 3357 - DNA, 20 bp, Artificial Sequence
  Synthetic
aacgaggcgcaccatggccc

SEQ ID NO: 3358 - DNA, 19 bp, Artificial Sequence
  Synthetic
caggttgttgtcgcgcgta

SEQ ID NO: 3359 - DNA, 19 bp, Artificial Sequence
  Synthetic
gaggttgttgtcgcgcgta

SEQ ID NO: 3360 - DNA, 13 bp, Artificial Sequence
  Synthetic
tctcgccctcgta

SEQ ID NO: 3361 - DNA, 14 bp, Artificial Sequence
  Synthetic
gggccatggtgcgc

SEQ ID NO: 3362 - DNA, 23 bp, Artificial Sequence
  Synthetic
aacgaggcgcaccacctggatca

SEQ ID NO: 3363 - DNA, 17 bp, Artificial Sequence
  Synthetic
ccctctcgccctcgtaa

SEQ ID NO: 3364 - DNA, 11 bp, Artificial Sequence
  Synthetic
gcaccccgggc

SEQ ID NO: 3365 - DNA, 17 bp, Artificial Sequence
  Synthetic
tgatccaggtggtgcgc

SEQ ID NO: 3366 - DNA, 21 bp, Artificial Sequence
  Synthetic
aacgaggcgcactcagcacca

SEQ ID NO: 3367 - DNA, 21 bp, Artificial Sequence
  Synthetic
ggcgatctccttcatcttgga

SEQ ID NO: 3368 - DNA, 21 bp, Artificial Sequence
  Synthetic
tgcagtctccttcatcttgga

SEQ ID NO: 3369 - DNA, 16 bp, Artificial Sequence
  Synthetic
tggacgagatctcctc

SEQ ID NO: 3370 - DNA, 15 bp, Artificial Sequence
  Synthetic
tggtgctgagtgcgc

SEQ ID NO: 3371 - DNA, 22 bp, Artificial Sequence
  Synthetic
aacgaggcgcacccactagctc

SEQ ID NO: 3372 - DNA, 22 bp, Artificial Sequence
  Synthetic
agttcagttcctgaagggagta

SEQ ID NO: 3373 - DNA, 17 bp, Artificial Sequence
  Synthetic
tcccactaatgtccagc

SEQ ID NO: 3374 - DNA, 16 bp, Artificial Sequence
  Synthetic
gagctagtgggtgcgc

SEQ ID NO: 3375 - DNA, 21 bp, Artificial Sequence
  Synthetic
aacgaggcgcacccttgtctc

SEQ ID NO: 3376 - DNA, 24 bp, Artificial Sequence
  Synthetic
cgtcctcacaccaggaaactcata

SEQ ID NO: 3377 - DNA, 14 bp, Artificial Sequence
  Synthetic
catagcagccttcc

SEQ ID NO: 3378 - DNA, 15 bp, Artificial Sequence
  Synthetic
gagacaagggtgcgc

SEQ ID NO: 3379 - DNA, 23 bp, Artificial Sequence
  Synthetic
aacgaggcgcaccttctcatctc

SEQ ID NO: 3380 - DNA, 19 bp, Artificial Sequence
  Synthetic
gcatcggttcagcccatca

SEQ ID NO: 3381 - DNA, 18 bp, Artificial Sequence
  Synthetic
ggatggaaatcagggagt

SEQ ID NO: 3382 - DNA, 17 bp, Artificial Sequence
  Synthetic
gagatgagaaggtgcgc

SEQ ID NO: 3383 - DNA, 23 bp, Artificial Sequence
  Synthetic
ccgtcacgcctccttctcatctc

SEQ ID NO: 3384 - DNA, 17 bp, Artificial Sequence
  Synthetic
gagatgagaaggaggcg

SEQ ID NO: 3385 - DNA, 23 bp, Artificial Sequence
  Synthetic
ccgtcgctgcgtcttctcatctc

SEQ ID NO: 3386 - DNA, 17 bp, Artificial Sequence
  Synthetic
gagatgagaagacgcag

SEQ ID NO: 3387 - DNA, 22 bp, Artificial Sequence
  Synthetic
aacgaggcgcacccttctcatc

SEQ ID NO: 3388 - DNA, 18 bp, Artificial Sequence
  Synthetic
gcatcggttcagcccata

SEQ ID NO: 3389 - DNA, 19 bp, Artificial Sequence
  Synthetic
tcggatggaaatcagggag

SEQ ID NO: 3390 - DNA, 16 bp, Artificial Sequence
  Synthetic
gatgagaagggtgcgc

SEQ ID NO: 3391 - DNA, 22 bp, Artificial Sequence
  Synthetic
ccgtcacgcctcccttctcatc

SEQ ID NO: 3392 - DNA, 16 bp, Artificial Sequence
  Synthetic
gatgagaagggaggcg

SEQ ID NO: 3393 - DNA, 29 bp, Artificial Sequence
  Synthetic
aacgaggcgcacgagagatgaggagaggg

SEQ ID NO: 3394 - DNA, 25 bp, Artificial Sequence
  Synthetic
gggccaggaaaggacagacaggaaa

SEQ ID NO: 3395 - DNA, 23 bp, Artificial Sequence
  Synthetic
ccctctcctcatctctcgtgcgc

SEQ ID NO: 3396 - DNA, 28 bp, Artificial Sequence
  Synthetic
aacgaggcgcacgagagatgaggagagg

SEQ ID NO: 3397 - DNA, 23 bp, Artificial Sequence
  Synthetic
gccaggaaaggacagacaggaac

SEQ ID NO: 3398 - DNA, 22 bp, Artificial Sequence
  Synthetic
cctctcctcatctctcgtgcgc

SEQ ID NO: 3399 - DNA, 26 bp, Artificial Sequence
  Synthetic
aacgaggcgcactggaggaaactcag

SEQ ID NO: 3400 - DNA, 29 bp, Artificial Sequence
  Synthetic
ggaattcaagctaataaagatatcatgaa

SEQ ID NO: 3401 - DNA, 19 bp, Artificial Sequence
  Synthetic
agctccaataggtacagcc

SEQ ID NO: 3402 - DNA, 20 bp, Artificial Sequence
  Synthetic
ctgagtttcctccagtgcgc

SEQ ID NO: 3403 - DNA, 23 bp, Artificial Sequence
  Synthetic
aacgaggcgcactcctttccaag

SEQ ID NO: 3404 - DNA, 24 bp, Artificial Sequence
  Synthetic
caagagtgtgggatctgagttgaa

SEQ ID NO: 3405 - DNA, 15 bp, Artificial Sequence
  Synthetic
gtatgcagcatggcc

SEQ ID NO: 3406 - DNA, 17 bp, Artificial Sequence
  Synthetic
cttggaaaggagtgcgc

SEQ ID NO: 3407 - DNA, 20 bp, Artificial Sequence
  Synthetic
gtatgcagcatggcctcctc

SEQ ID NO: 3408 - DNA, 20 bp, Artificial Sequence
  Synthetic
aacgaggcgcactcggccca

SEQ ID NO: 3409 - DNA, 22 bp, Artificial Sequence
  Synthetic
ccatctgtcacgtcatacctga

SEQ ID NO: 3410 - DNA, 13 bp, Artificial Sequence
  Synthetic
gccatcactgccc

SEQ ID NO: 3411 - DNA, 14 bp, Artificial Sequence
  Synthetic
tgggccgagtgcgc

SEQ ID NO: 3412 - DNA, 22 bp, Artificial Sequence
  Synthetic
ccatctgtcacgtcatacctga

SEQ ID NO: 3413 - DNA, 21 bp, Artificial Sequence
  Synthetic
aacgaggcgcacgtcctgtgc

SEQ ID NO: 3414 - DNA, 22 bp, Artificial Sequence
  Synthetic
agtcttttccaattcgctcctc

SEQ ID NO: 3415 - DNA, 19 bp, Artificial Sequence
  Synthetic
atttgcgatctgtgtcttc

SEQ ID NO: 3416 - DNA, 15 bp, Artificial Sequence
  Synthetic
gcacaggacgtgcgc

SEQ ID NO: 3417 - DNA, 21 bp, Artificial Sequence
  Synthetic
ccgtcacgcctcgtcctgtgc

SEQ ID NO: 3418 - DNA, 15 bp, Artificial Sequence
  Synthetic
gcacaggacgaggcg

SEQ ID NO: 3419 - DNA, 25 bp, Artificial Sequence
  Synthetic
aacgaggcgcaccttctttcataag

SEQ ID NO: 3420 - DNA, 25 bp, Artificial Sequence
  Synthetic
cttctttcgtagttctgcattgcga

SEQ ID NO: 3421 - DNA, 23 bp, Artificial Sequence
  Synthetic
ccacagaatttaaagctcttttg

SEQ ID NO: 3422 - DNA, 19 bp, Artificial Sequence
  Synthetic
cttatgaaagaaggtgcgc

SEQ ID NO: 3423 - DNA, 25 bp, Artificial Sequence
  Synthetic
ccgtcacgcctccttctttcataag

SEQ ID NO: 3424 - DNA, 19 bp, Artificial Sequence
  Synthetic
cttatgaaagaaggaggcg

SEQ ID NO: 3425 - DNA, 21 bp, Artificial Sequence
  Synthetic
ccgtcacgcctcgtcttggcc

SEQ ID NO: 3426 - DNA, 22 bp, Artificial Sequence
  Synthetic
gcccagagaatagcgaggtgca

SEQ ID NO: 3427 - DNA, 22 bp, Artificial Sequence
  Synthetic
ttctccatgtcgtcaaaggtgg

SEQ ID NO: 3428 - DNA, 15 bp, Artificial Sequence
  Synthetic
ggccaagacgaggcg

SEQ ID NO: 3429 - DNA, 24 bp, Artificial Sequence
  Synthetic
aacgaggcgcacctttcagttttg

SEQ ID NO: 3430 - DNA, 32 bp, Artificial Sequence
  Synthetic
tctatgtcatgttcacaggtaagaatttctga

SEQ ID NO: 3431 - DNA, 17 bp, Artificial Sequence
  Synthetic
ctttctcagatcttggc

SEQ ID NO: 3432 - DNA, 18 bp, Artificial Sequence
  Synthetic
caaaactgaaaggtgcgc

SEQ ID NO: 3433 - DNA, 24 bp, Artificial Sequence
  Synthetic
ccgtcacgcctcctttcagttttg

SEQ ID NO: 3434 - DNA, 18 bp, Artificial Sequence
  Synthetic
caaaactgaaaggaggcg

SEQ ID NO: 3435 - DNA, 13 bp, Artificial Sequence
  Synthetic
  misc_feature (3)..(3): The residue at this position is linked to a Z28 quenching group.
cactgcttcgtgg

SEQ ID NO: 3436 - DNA, 27 bp, Artificial Sequence
  Synthetic
ccaggaagcaagtggtgcgcctcgttt

SEQ ID NO: 3437 - DNA, 27 bp, Artificial Sequence
  Synthetic
ccaggaagcaagtggaggcgtgacggt

SEQ ID NO: 3438 - DNA, 27 bp, Artificial Sequence
  Synthetic
ccaggaagcaagtgacgcagcgacggt

SEQ ID NO: 3439 - DNA, 23 bp, Artificial Sequence
  Synthetic
aacgaggcgcactcagtggagag

SEQ ID NO: 3440 - DNA, 17 bp, Artificial Sequence
  Synthetic
ggtctgcctcgtgagca

SEQ ID NO: 3441 - DNA, 16 bp, Artificial Sequence
  Synthetic
gtaagccaccacgatg

SEQ ID NO: 3442 - DNA, 16 bp, Artificial Sequence
  Synthetic
tctccactgagtgcgc

SEQ ID NO: 3443 - DNA, 21 bp, Artificial Sequence
  Synthetic
aacgaggcgcacccaggtgtg

SEQ ID NO: 3444 - DNA, 22 bp, Artificial Sequence
  Synthetic
tcactgcagggacttacccaga

SEQ ID NO: 3445 - DNA, 13 bp, Artificial Sequence
  Synthetic
tgtgtctgagccc

SEQ ID NO: 3446 - DNA, 14 bp, Artificial Sequence
  Synthetic
acacctgggtgcgc

SEQ ID NO: 3447 - DNA, 20 bp, Artificial Sequence
  Synthetic
aacgaggcgcacccaggtgt

SEQ ID NO: 3448 - DNA, 14 bp, Artificial Sequence
  Synthetic
gtgtgtctgagccc

SEQ ID NO: 3449 - DNA, 21 bp, Artificial Sequence
  Synthetic
aacgaggcgcacccttcctct

SEQ ID NO: 3450 - DNA, 17 bp, Artificial Sequence
  Synthetic
ggaggaggagggctgga

SEQ ID NO: 3451 - DNA, 18 bp, Artificial Sequence
  Synthetic
tgggactattgatcaggg

SEQ ID NO: 3452 - DNA, 15 bp, Artificial Sequence
  Synthetic
agaggaagggtgcgc

SEQ ID NO: 3453 - DNA, 25 bp, Artificial Sequence
  Synthetic
aacgaggcgcaccttcattattggc

SEQ ID NO: 3454 - DNA, 24 bp, Artificial Sequence
  Synthetic
ccacaagcttccgagtgcgtcata

SEQ ID NO: 3455 - DNA, 20 bp, Artificial Sequence
  Synthetic
cacaggaaacgacttcttgg

SEQ ID NO: 3456 - DNA, 19 bp, Artificial Sequence
  Synthetic
gccaataatgaaggtgcgc

SEQ ID NO: 3457 - DNA, 20 bp, Artificial Sequence
  Synthetic
aacgaggcgcaccgctgcgt

SEQ ID NO: 3458 - DNA, 17 bp, Artificial Sequence
  Synthetic
ggccctgcacctcagaa

SEQ ID NO: 3459 - DNA, 14 bp, Artificial Sequence
  Synthetic
gtgagcttctgggg

SEQ ID NO: 3460 - DNA, 14 bp, Artificial Sequence
  Synthetic
acgcagcggtgcgc

SEQ ID NO: 3461 - DNA, 21 bp, Artificial Sequence
  Synthetic
aacgaggcgcacctgtccgtc

SEQ ID NO: 3462 - DNA, 26 bp, Artificial Sequence
  Synthetic
cagattcagccagagtgtgaagtaga

SEQ ID NO: 3463 - DNA, 18 bp, Artificial Sequence
  Synthetic
ttcttggagcaaaggtag

SEQ ID NO: 3464 - DNA, 16 bp, Artificial Sequence
  Synthetic
agacggacaggtgcgc

SEQ ID NO: 3465 - DNA, 22 bp, Artificial Sequence
  Synthetic
aacgaggcgcacctgtccgtct

SEQ ID NO: 3466 - DNA, 18 bp, Artificial Sequence
  Synthetic
tcttggagcaaaggtagt

SEQ ID NO: 3467 - DNA, 22 bp, Artificial Sequence
  Synthetic
aacgaggcgcacccagagtgtg

SEQ ID NO: 3468 - DNA, 23 bp, Artificial Sequence
  Synthetic
gcagaagcagttccagattcaga

SEQ ID NO: 3469 - DNA, 16 bp, Artificial Sequence
  Synthetic
aagtagctgtccgtct

SEQ ID NO: 3470 - DNA, 16 bp, Artificial Sequence
  Synthetic
cacactctgggtgcgc

SEQ ID NO: 3471 - DNA, 21 bp, Artificial Sequence
  Synthetic
aacgaggcgcacccagagtgt

SEQ ID NO: 3472 - DNA, 16 bp, Artificial Sequence
  Synthetic
gaagtagctgtccgtc

SEQ ID NO: 3473 - DNA, 26 bp, Artificial Sequence
  Synthetic
aacgaggcgcaccagaaagtagagca

SEQ ID NO: 3474 - DNA, 20 bp, Artificial Sequence
  Synthetic
agacttgtggctgccgctga

SEQ ID NO: 3475 - DNA, 17 bp, Artificial Sequence
  Synthetic
tgtacacgttgcccatg

SEQ ID NO: 3476 - DNA, 20 bp, Artificial Sequence
  Synthetic
tgctctactttctggtgcgc

SEQ ID NO: 3477 - DNA, 13 bp, Artificial Sequence
  Synthetic
  misc_feature (3)..(3): The residue at this position is linked to a Z28 quenching group.
cactgcttcgtgg

SEQ ID NO: 3478 - DNA, 27 bp, Artificial Sequence
  Synthetic
ccaggaagcaagtggtgcgcctcgttt

SEQ ID NO: 3479 - DNA, 27 bp, Artificial Sequence
  Synthetic
ccaggaagcaagtggaggcgtgacggt

SEQ ID NO: 3480 - DNA, 27 bp, Artificial Sequence
  Synthetic
ccaggaagcaagtgacgcagcgacggt

SEQ ID NO: 3481 - DNA, 23 bp, Artificial Sequence
  Synthetic
aacgaggcgcaccatgcggatct

SEQ ID NO: 3482 - DNA, 18 bp, Artificial Sequence
  Synthetic
gccttccctcggagcgaa

SEQ ID NO: 3483 - DNA, 16 bp, Artificial Sequence
  Synthetic
gctgcatctgcttgga

SEQ ID NO: 3484 - DNA, 17 bp, Artificial Sequence
  Synthetic
agatccgcatggtgcgc

SEQ ID NO: 3485 - DNA, 23 bp, Artificial Sequence
  Synthetic
aacgaggcgcacctgcacatcac

SEQ ID NO: 3486 - DNA, 25 bp, Artificial Sequence
  Synthetic
caccttgtctccagtctttatcaga

SEQ ID NO: 3487 - DNA, 19 bp, Artificial Sequence
  Synthetic
tcagaatttcaatggtgcc

SEQ ID NO: 3488 - DNA, 17 bp, Artificial Sequence
  Synthetic
gtgatgtgcaggtgcgc

SEQ ID NO: 3489 - DNA, 24 bp, Artificial Sequence
  Synthetic
aacgaggcgcacctgcacatcact

SEQ ID NO: 3490 - DNA, 19 bp, Artificial Sequence
  Synthetic
cagaatttcaatggtgcct

SEQ ID NO: 3491 - DNA, 24 bp, Artificial Sequence
  Synthetic
aacgaggcgcacctccacagacaa

SEQ ID NO: 3492 - DNA, 26 bp, Artificial Sequence
  Synthetic
cagtaagtgggaaggtgtactcagta

SEQ ID NO: 3493 - DNA, 14 bp, Artificial Sequence
  Synthetic
tgccaggacgcgct

SEQ ID NO: 3494 - DNA, 18 bp, Artificial Sequence
  Synthetic
ttgtctgtggaggtgcgc

SEQ ID NO: 3495 - DNA, 21 bp, Artificial Sequence
  Synthetic
aacgaggcgcacctccaggtg

SEQ ID NO: 3496 - DNA, 20 bp, Artificial Sequence
  Synthetic
tctccagagctgggttgtta

SEQ ID NO: 3497 - DNA, 13 bp, Artificial Sequence
  Synthetic
gcccctgatagcc

SEQ ID NO: 3498 - DNA, 14 bp, Artificial Sequence
  Synthetic
acctggaggtgcgc

SEQ ID NO: 3499 - DNA, 24 bp, Artificial Sequence
  Synthetic
aacgaggcgcaccatgcggatctg

SEQ ID NO: 3500 - DNA, 18 bp, Artificial Sequence
  Synthetic
gccttccctcggagcgaa

SEQ ID NO: 3501 - DNA, 16 bp, Artificial Sequence
  Synthetic
ctgcatctgcttggag

SEQ ID NO: 3502 - DNA, 18 bp, Artificial Sequence
  Synthetic
cagatccgcatggtgcgc

SEQ ID NO: 3503 - DNA, 24 bp, Artificial Sequence
  Synthetic
aacgaggcgcacacatgcggatct

SEQ ID NO: 3504 - DNA, 17 bp, Artificial Sequence
  Synthetic
gccttccctcggagcgc

SEQ ID NO: 3505 - DNA, 15 bp, Artificial Sequence
  Synthetic
gctgcatctgcttgg

SEQ ID NO: 3506 - DNA, 18 bp, Artificial Sequence
  Synthetic
agatccgcatgtgtgcgc

SEQ ID NO: 3507 - DNA, 25 bp, Artificial Sequence
  Synthetic
ccgtcacgcctcccattatgctaca

SEQ ID NO: 3508 - DNA, 23 bp, Artificial Sequence
  Synthetic
ttgtccccgtacttgatgttgta

SEQ ID NO: 3509 - DNA, 16 bp, Artificial Sequence
  Synthetic
gtcaaacagcactggc

SEQ ID NO: 3510 - DNA, 19 bp, Artificial Sequence
  Synthetic
tgtagcataatgggaggcg

SEQ ID NO: 3511 - DNA, 25 bp, Artificial Sequence
  Synthetic
aacgaggcgcacccattatgctaca

SEQ ID NO: 3512 - DNA, 19 bp, Artificial Sequence
  Synthetic
tgtagcataatgggtgcgc

SEQ ID NO: 3513 - DNA, 23 bp, Artificial Sequence
  Synthetic
aacgaggcgcacggagacaatcc

SEQ ID NO: 3514 - DNA, 22 bp, Artificial Sequence
  Synthetic
gtcaaacagcactggctcctgc

SEQ ID NO: 3515 - DNA, 20 bp, Artificial Sequence
  Synthetic
cgatgttggaacggaggaac

SEQ ID NO: 3516 - DNA, 17 bp, Artificial Sequence
  Synthetic
ggattgtctccgtgcgc

SEQ ID NO: 3517 - DNA, 23 bp, Artificial Sequence
  Synthetic
ccgtcacgcctcggagacaatcc

SEQ ID NO: 3518 - DNA, 17 bp, Artificial Sequence
  Synthetic
ggattgtctccgaggcg

SEQ ID NO: 3519 - DNA, 23 bp, Artificial Sequence
  Synthetic
aacgaggcgcacggattccgtat

SEQ ID NO: 3520 - DNA, 26 bp, Artificial Sequence
  Synthetic
agccatatccagaagcaagatcttgc

SEQ ID NO: 3521 - DNA, 12 bp, Artificial Sequence
  Synthetic
gagggctcgggc

SEQ ID NO: 3522 - DNA, 17 bp, Artificial Sequence
  Synthetic
atacggaatccgtgcgc

SEQ ID NO: 3523 - DNA, 23 bp, Artificial Sequence
  Synthetic
ccgtcacgcctcggattccgtat

SEQ ID NO: 3524 - DNA, 17 bp, Artificial Sequence
  Synthetic
atacggaatccgaggcg

SEQ ID NO: 3525 - DNA, 20 bp, Artificial Sequence
  Synthetic
aacgaggcgcaccttctggc

SEQ ID NO: 3526 - DNA, 19 bp, Artificial Sequence
  Synthetic
ctcttgcagctcgtgcaga

SEQ ID NO: 3527 - DNA, 11 bp, Artificial Sequence
  Synthetic
gcgcgccctct

SEQ ID NO: 3528 - DNA, 14 bp, Artificial Sequence
  Synthetic
gccagaaggtgcgc

SEQ ID NO: 3529 - DNA, 21 bp, Artificial Sequence
  Synthetic
aacgaggcgcaccttctggcg

SEQ ID NO: 3530 - DNA, 12 bp, Artificial Sequence
  Synthetic
cgcgccctcttg

SEQ ID NO: 3531 - DNA, 21 bp, Artificial Sequence
  Synthetic
aacgaggcgcaccgctgtagg

SEQ ID NO: 3532 - DNA, 16 bp, Artificial Sequence
  Synthetic
gctggcgcagctcgta

SEQ ID NO: 3533 - DNA, 13 bp, Artificial Sequence
  Synthetic
gggccagatgcgt

SEQ ID NO: 3534 - DNA, 15 bp, Artificial Sequence
  Synthetic
cctacagcggtgcgc

SEQ ID NO: 3535 - DNA, 21 bp, Artificial Sequence
  Synthetic
aacgaggcgcacctcagcctt

SEQ ID NO: 3536 - DNA, 21 bp, Artificial Sequence
  Synthetic
ggccgtgtgtggttactgaga

SEQ ID NO: 3537 - DNA, 13 bp, Artificial Sequence
  Synthetic
gggcgtggtgtgc

SEQ ID NO: 3538 - DNA, 15 bp, Artificial Sequence
  Synthetic
aaggctgaggtgcgc

SEQ ID NO: 3539 - DNA, 22 bp, Artificial Sequence
  Synthetic
aacgaggcgcacctcagccttg

SEQ ID NO: 3540 - DNA, 13 bp, Artificial Sequence
  Synthetic
ggcgtggtgtgcg

SEQ ID NO: 3541 - DNA, 21 bp, Artificial Sequence
  Synthetic
aacgaggcgcaccagccttgg

SEQ ID NO: 3542 - DNA, 21 bp, Artificial Sequence
  Synthetic
ccgtgtgtggttactgagcta

SEQ ID NO: 3543 - DNA, 13 bp, Artificial Sequence
  Synthetic
gcgtggtgtgcgg

SEQ ID NO: 3544 - DNA, 15 bp, Artificial Sequence
  Synthetic
ccaaggctggtgcgc

SEQ ID NO: 3545 - DNA, 20 bp, Artificial Sequence
  Synthetic
aacgaggcgcacgctccttc

SEQ ID NO: 3546 - DNA, 16 bp, Artificial Sequence
  Synthetic
gctcctgctcctgtgc

SEQ ID NO: 3547 - DNA, 17 bp, Artificial Sequence
  Synthetic
tgctgttgctcacattc

SEQ ID NO: 3548 - DNA, 14 bp, Artificial Sequence
  Synthetic
gaaggagcgtgcgc

SEQ ID NO: 3549 - DNA, 21 bp, Artificial Sequence
  Synthetic
aacgaggcgcacgctccttct

SEQ ID NO: 3550 - DNA, 17 bp, Artificial Sequence
  Synthetic
gctgttgctcacattct

SEQ ID NO: 3551 - DNA, 23 bp, Artificial Sequence
  Synthetic
ccgtcacgcctcgctccttctgc

SEQ ID NO: 3552 - DNA, 18 bp, Artificial Sequence
  Synthetic
cagctcctgctcctgtgc

SEQ ID NO: 3553 - DNA, 24 bp, Artificial Sequence
  Synthetic
tgttgctcacattcttgctcaggc

SEQ ID NO: 3554 - DNA, 17 bp, Artificial Sequence
  Synthetic
gcagaaggagcgaggcg

SEQ ID NO: 3555 - DNA, 22 bp, Artificial Sequence
  Synthetic
aacgaggcgcacctggacgttg

SEQ ID NO: 3556 - DNA, 34 bp, Artificial Sequence
  Synthetic
ggaagaacaattttcaatcatttcatagtacata

SEQ ID NO: 3557 - DNA, 11 bp, Artificial Sequence
  Synthetic
gtggcagcccg

SEQ ID NO: 3558 - DNA, 16 bp, Artificial Sequence
  Synthetic
caacgtccaggtgcgc

SEQ ID NO: 3559 - DNA, 28 bp, Artificial Sequence
  Synthetic
aacgaggcgcacatcatttcatagtaca

SEQ ID NO: 3560 - DNA, 26 bp, Artificial Sequence
  Synthetic
ggcagtggtggaagaacaattttcac

SEQ ID NO: 3561 - DNA, 15 bp, Artificial Sequence
  Synthetic
tctggacgttggtgg

SEQ ID NO: 3562 - DNA, 22 bp, Artificial Sequence
  Synthetic
tgtactatgaaatgatgtgcgc

SEQ ID NO: 3563 - DNA, 31 bp, Artificial Sequence
  Synthetic
aacgaggcgcacatcatttcatagtacatct

SEQ ID NO: 3564 - DNA, 31 bp, Artificial Sequence
  Synthetic
agtttggcagtggtggaagaacaattttcag

SEQ ID NO: 3565 - DNA, 18 bp, Artificial Sequence
  Synthetic
ggacgttggtggcagccc

SEQ ID NO: 3566 - DNA, 25 bp, Artificial Sequence
  Synthetic
agatgtactatgaaatgatgtgcgc

SEQ ID NO: 3567 - DNA, 24 bp, Artificial Sequence
  Synthetic
aacgaggcgcacctctagtgatct

SEQ ID NO: 3568 - DNA, 25 bp, Artificial Sequence
  Synthetic
ctctctgtttacaggtaaggtgtga

SEQ ID NO: 3569 - DNA, 17 bp, Artificial Sequence
  Synthetic
tgcttcacaccaaggac

SEQ ID NO: 3570 - DNA, 18 bp, Artificial Sequence
  Synthetic
agatcactagaggtgcgc

SEQ ID NO: 3571 - DNA, 28 bp, Artificial Sequence
  Synthetic
ccgtcacgcctcctctagtgatcttgct

SEQ ID NO: 3572 - DNA, 27 bp, Artificial Sequence
  Synthetic
gtctctctgtttacaggtaaggtgtgg

SEQ ID NO: 3573 - DNA, 22 bp, Artificial Sequence
  Synthetic
agcaagatcactagaggaggcg

SEQ ID NO: 3574 - DNA, 13 bp, Artificial Sequence
  Synthetic
  misc_feature (3)..(3): The residue at this position is linked to a Z28 quenching group.
cactgcttcgtgg

SEQ ID NO: 3575 - DNA, 27 bp, Artificial Sequence
  Synthetic
ccaggaagcaagtggtgcgcctcgttt

SEQ ID NO: 3576 - DNA, 27 bp, Artificial Sequence
  Synthetic
ccaggaagcaagtggaggcgtgacggt

SEQ ID NO: 3577 - DNA, 27 bp, Artificial Sequence
  Synthetic
ccaggaagcaagtgacgcagcgacggt

SEQ ID NO: 3578 - DNA, 26 bp, Artificial Sequence
  Synthetic
aacgaggcgcacagaggttagagaag

SEQ ID NO: 3579 - DNA, 26 bp, Artificial Sequence
  Synthetic
ggaggaagggctctagtataataggc

SEQ ID NO: 3580 - DNA, 19 bp, Artificial Sequence
  Synthetic
gcttcccagcttttgtagc

SEQ ID NO: 3581 - DNA, 20 bp, Artificial Sequence
  Synthetic
cttctctaacctctgtgcgc

SEQ ID NO: 3582 - DNA, 25 bp, Artificial Sequence
  Synthetic
ccgtcacgcctcgttggctcttccc

SEQ ID NO: 3583 - DNA, 18 bp, Artificial Sequence
  Synthetic
ggcttgggcttccgtctc

SEQ ID NO: 3584 - DNA, 19 bp, Artificial Sequence
  Synthetic
gggaagagccaacgaggcg

SEQ ID NO: 3585 - DNA, 24 bp, Artificial Sequence
  Synthetic
ccgtcacgcctcgcctatgtcctt

SEQ ID NO: 3586 - DNA, 26 bp, Artificial Sequence
  Synthetic
aggtcgcttagtccaacttaatgaac

SEQ ID NO: 3587 - DNA, 23 bp, Artificial Sequence
  Synthetic
cgcgtactgacggaagcactgtc

SEQ ID NO: 3588 - DNA, 18 bp, Artificial Sequence
  Synthetic
aaggacataggcgaggcg

SEQ ID NO: 3589 - DNA, 26 bp, Artificial Sequence
  Synthetic
aacgaggcgcacgcttccgatgtact

SEQ ID NO: 3590 - DNA, 34 bp, Artificial Sequence; identical to SEQ ID NO: 3105
  Synthetic

SEQ ID NO: 3591 - DNA, 39 bp, Artificial Sequence; identical to SEQ ID NO: 3106
  Synthetic

SEQ ID NO: 3592 - DNA, 20 bp, Artificial Sequence
  Synthetic
agtacatcggaagcgtgcgc

SEQ ID NO: 3593 - DNA, 20 bp, Artificial Sequence
  Synthetic
aacgaggcgcacgcttccga

SEQ ID NO: 3594 - DNA, 23 bp, Artificial Sequence
  Synthetic
gcaacattctggcccatgatgtc

SEQ ID NO: 3595 - DNA, 22 bp, Artificial Sequence
  Synthetic
tgtacttctgcattaaattcct

SEQ ID NO: 3596 - DNA, 14 bp, Artificial Sequence
  Synthetic
tcggaagcgtgcgc

SEQ ID NO: 3597 - DNA, 20 bp, Artificial Sequence
  Synthetic
aacgaggcgcaccttccgat

SEQ ID NO: 3598 - DNA, 24 bp, Artificial Sequence
  Synthetic
gcaacattctggcccatgatgtga

SEQ ID NO: 3599 - DNA, 21 bp, Artificial Sequence
  Synthetic
gtacttctgcattaaattcct

SEQ ID NO: 3600 - DNA, 14 bp, Artificial Sequence
  Synthetic
atcggaaggtgcgc

SEQ ID NO: 3601 - DNA, 25 bp, Artificial Sequence
  Synthetic
ccgtcacgcctcctctttgcttaac

SEQ ID NO: 3602 - DNA, 43 bp, Artificial Sequence
  Synthetic
cattttccttggctagaaaacgaactctgtacgtataaggaca

SEQ ID NO: 3603 - DNA, 26 bp, Artificial Sequence
  Synthetic
ttgaatgttgctgctgttcatcatca

SEQ ID NO: 3604 - DNA, 19 bp, Artificial Sequence
  Synthetic
gttaagcaaagaggaggcg

SEQ ID NO: 3605 - DNA, 24 bp, Artificial Sequence
  Synthetic
ccgtcacgcctccgattccttcca

SEQ ID NO: 3606 - DNA, 27 bp, Artificial Sequence
  Synthetic
cacgtctgtcttatagtggagactcaa

SEQ ID NO: 3607 - DNA, 29 bp, Artificial Sequence
  Synthetic
cataccgatagatgatttcccagagccgc

SEQ ID NO: 3608 - DNA, 18 bp, Artificial Sequence
  Synthetic
tggaaggaatcggaggcg

SEQ ID NO: 3609 - DNA, 22 bp, Artificial Sequence
  Synthetic
aacgaggcgcaccgaacagtgt

SEQ ID NO: 3610 - DNA, 16 bp, Artificial Sequence
  Synthetic
acactgttcggtgcgc

SEQ ID NO: 3611 - DNA, 22 bp, Artificial Sequence
  Synthetic
ccgtcacgcctccgaacagtgt

SEQ ID NO: 3612 - DNA, 16 bp, Artificial Sequence
  Synthetic
acactgttcggaggcg

SEQ ID NO: 3613 - DNA, 19 bp, Artificial Sequence
  Synthetic
gcagggagaagtcagctta

SEQ ID NO: 3614 - DNA, 11 bp, Artificial Sequence
  Synthetic
gcctccctcca

SEQ ID NO: 3615 - DNA, 23 bp, Artificial Sequence
  Synthetic
aacgaggcgcacgtactcgtagg

SEQ ID NO: 3616 - DNA, 17 bp, Artificial Sequence
  Synthetic
cctacgagtacgtgcgc

SEQ ID NO: 3617 - DNA, 23 bp, Artificial Sequence
  Synthetic
ccgtcacgcctcgtactcgtagg

SEQ ID NO: 3618 - DNA, 17 bp, Artificial Sequence
  Synthetic
cctacgagtacgaggcg

SEQ ID NO: 3619 - DNA, 16 bp, Artificial Sequence
  Synthetic
cacgctgggccgcagc

SEQ ID NO: 3620 - DNA, 15 bp, Artificial Sequence
  Synthetic
gcatgtccagctttg

SEQ ID NO: 3621 - DNA, 26 bp, Artificial Sequence
  Synthetic
ccgtcacgcctcttgtagacatcctg

SEQ ID NO: 3622 - DNA, 32 bp, Artificial Sequence
  Synthetic
gccaacaggaacagtaccaataccaccaatta

SEQ ID NO: 3623 - DNA, 18 bp, Artificial Sequence
  Synthetic
gagaggcaggcgcaaggg

SEQ ID NO: 3624 - DNA, 20 bp, Artificial Sequence
  Synthetic
caggatgtctacaagaggcg

SEQ ID NO: 3625 - DNA, 21 bp, Artificial Sequence
  Synthetic
ccgtcacgcctccccgttttc

SEQ ID NO: 3626 - DNA, 15 bp, Artificial Sequence
  Synthetic
gaaaacggggaggcg

SEQ ID NO: 3627 - DNA, 21 bp, Artificial Sequence
  Synthetic
aacgaggcgcaccccgttttc

SEQ ID NO: 3628 - DNA, 15 bp, Artificial Sequence
  Synthetic
gaaaacggggtgcgc

SEQ ID NO: 3629 - DNA, 23 bp, Artificial Sequence
  Synthetic
gggcatctgttgcacgtagacaa

SEQ ID NO: 3630 - DNA, 15 bp, Artificial Sequence
  Synthetic
ttctcagatcccgtc

SEQ ID NO: 3631 - DNA, 22 bp, Artificial Sequence
  Synthetic
ccgtcacgcctccccgttttct

SEQ ID NO: 3632 - DNA, 23 bp, Artificial Sequence
  Synthetic
gggcatctgttgcacgtagacaa

SEQ ID NO: 3633 - DNA, 15 bp, Artificial Sequence
  Synthetic
tctcagatcccgtca

SEQ ID NO: 3634 - DNA, 16 bp, Artificial Sequence
  Synthetic
agaaaacggggaggcg

SEQ ID NO: 3635 - DNA, 23 bp, Artificial Sequence
  Synthetic
aacgaggcgcacctccaatctca

SEQ ID NO: 3636 - DNA, 26 bp, Artificial Sequence
  Synthetic
cccccactaagatttatacccttcta

SEQ ID NO: 3637 - DNA, 15 bp, Artificial Sequence
  Synthetic
gccaaatctcctcca

SEQ ID NO: 3638 - DNA, 17 bp, Artificial Sequence
  Synthetic
tgagattggaggtgcgc

SEQ ID NO: 3639 - DNA, 21 bp, Artificial Sequence
  Synthetic
aacgaggcgcactcggactgt

SEQ ID NO: 3640 - DNA, 24 bp, Artificial Sequence
  Synthetic
gccataatgtccaggttcacatca

SEQ ID NO: 3641 - DNA, 17 bp, Artificial Sequence
  Synthetic
ggcttccgaatcatgtt

SEQ ID NO: 3642 - DNA, 15 bp, Artificial Sequence
  Synthetic
acagtccgagtgcgc

SEQ ID NO: 3643 - DNA, 24 bp, Artificial Sequence
  Synthetic
aacgaggcgcaccaaacctgttca

SEQ ID NO: 3644 - DNA, 25 bp, Artificial Sequence
  Synthetic
catccactgtggaaatatcgccgga

SEQ ID NO: 3645 - DNA, 14 bp, Artificial Sequence
  Synthetic
caatccggcctgtg

SEQ ID NO: 3646 - DNA, 18 bp, Artificial Sequence
  Synthetic
tgaacaggtttggtgcgc

SEQ ID NO: 3647 - DNA, 22 bp, Artificial Sequence
  Synthetic
aacgaggcgcacgcaactcgca

SEQ ID NO: 3648 - DNA, 18 bp, Artificial Sequence
  Synthetic
ggcctgcagagactctgc

SEQ ID NO: 3649 - DNA, 15 bp, Artificial Sequence
  Synthetic
gccactgctaagcac

SEQ ID NO: 3650 - DNA, 16 bp, Artificial Sequence
  Synthetic
tgcgagttgcgtgcgc

SEQ ID NO: 3651 - DNA, 21 bp, Artificial Sequence
  Synthetic
aacgaggcgcaccctctctga

SEQ ID NO: 3652 - DNA, 28 bp, Artificial Sequence
  Synthetic
gccttttaaaaggaaagggcaaccttga

SEQ ID NO: 3653 - DNA, 15 bp, Artificial Sequence
  Synthetic
tggtcctgacctaca

SEQ ID NO: 3654 - DNA, 15 bp, Artificial Sequence
  Synthetic
tcagagagggtgcgc

SEQ ID NO: 3655 - DNA, 21 bp, Artificial Sequence
  Synthetic
aacgaggcgcacgatagccag

SEQ ID NO: 3656 - DNA, 31 bp, Artificial Sequence
  Synthetic
tgcatccttcacatgtcatgacattgaagtc

SEQ ID NO: 3657 - DNA, 12 bp, Artificial Sequence
  Synthetic
tggccttgtccc

SEQ ID NO: 3658 - DNA, 15 bp, Artificial Sequence
  Synthetic
ctggctatcgtgcgc

SEQ ID NO: 3659 - DNA, 21 bp, Artificial Sequence
  Synthetic
aacgaggcgcacgcagtgtct

SEQ ID NO: 3660 - DNA, 20 bp, Artificial Sequence
  Synthetic
aagttgctggaagccacctc

SEQ ID NO: 3661 - DNA, 16 bp, Artificial Sequence
  Synthetic
tccaagcagtaggaca

SEQ ID NO: 3662 - DNA, 15 bp, Artificial Sequence
  Synthetic
agacactgcgtgcgc

SEQ ID NO: 3663 - DNA, 21 bp, Artificial Sequence
  Synthetic
aacgaggcgcaccatccagag

SEQ ID NO: 3664 - DNA, 30 bp, Artificial Sequence
  Synthetic
cctccaaaaggaaactggaggtatacttta

SEQ ID NO: 3665 - DNA, 17 bp, Artificial Sequence
  Synthetic
cctctttggtactaagc

SEQ ID NO: 3666 - DNA, 15 bp, Artificial Sequence
  Synthetic
ctctggatggtgcgc

SEQ ID NO: 3667 - DNA, 25 bp, Artificial Sequence
  Synthetic
aacgaggcgcaccttctattagtga

SEQ ID NO: 3668 - DNA, 35 bp, Artificial Sequence
  Synthetic
cagattcatgaagaaccctgtatcattgatatcaa

SEQ ID NO: 3669 - DNA, 24 bp, Artificial Sequence
  Synthetic
tgtttgacatcagatcttctaaat

SEQ ID NO: 3670 - DNA, 19 bp, Artificial Sequence
  Synthetic
tcactaatagaaggtgcgc

SEQ ID NO: 3671 - DNA, 24 bp, Artificial Sequence
  Synthetic
aacgaggcgcacaatatcctgtcc

SEQ ID NO: 3672 - DNA, 29 bp, Artificial Sequence
  Synthetic
cccgtagaaaccttacatttatggtcctc

SEQ ID NO: 3673 - DNA, 24 bp, Artificial Sequence
  Synthetic
atcaacactgaccatcccctctgt

SEQ ID NO: 3674 - DNA, 18 bp, Artificial Sequence
  Synthetic
ggacaggatattgtgcgc

SEQ ID NO: 3675 - DNA, 24 bp, Artificial Sequence
  Synthetic
aacgaggcgcaccatttcctgctg

SEQ ID NO: 3676 - DNA, 32 bp, Artificial Sequence
  Synthetic
gattcatcagctgcattttctaattcaactta

SEQ ID NO: 3677 - DNA, 20 bp, Artificial Sequence
  Synthetic
tctgcattgtgacaagtttg

SEQ ID NO: 3678 - DNA, 18 bp, Artificial Sequence
  Synthetic
cagcaggaaatggtgcgc

SEQ ID NO: 3679 - DNA, 21 bp, Artificial Sequence
  Synthetic
ccgtcacgcctccatccagag

SEQ ID NO: 3680 - DNA, 30 bp, Artificial Sequence; identical to SEQ ID NO: 3664
  Synthetic

SEQ ID NO: 3681 - DNA, 17 bp, Artificial Sequence
  Synthetic
cctctttggtactaagc

SEQ ID NO: 3682 - DNA, 15 bp, Artificial Sequence
  Synthetic
ctctggatggaggcg

SEQ ID NO: 3683 - DNA, 23 bp, Artificial Sequence
  Synthetic
aacgaggcgcacctttcaaggtg

SEQ ID NO: 3684 - DNA, 20 bp, Artificial Sequence
  Synthetic
ctgtaggccccaaagacgta

SEQ ID NO: 3685 - DNA, 14 bp, Artificial Sequence
  Synthetic
acaggcttgcctgt

SEQ ID NO: 3686 - DNA, 23 bp, Artificial Sequence
  Synthetic
caccttgaaaggtgcgcctcgtt

SEQ ID NO: 3687 - DNA, 24 bp, Artificial Sequence
  Synthetic
aacgaggcgcacttcactccaaat

SEQ ID NO: 3688 - DNA, 28 bp, Artificial Sequence
  Synthetic
tcttgtggattgttgagagagtcgatga

SEQ ID NO: 3689 - DNA, 20 bp, Artificial Sequence
  Synthetic
gatgtgctagtgatcacatc

SEQ ID NO: 3690 - DNA, 24 bp, Artificial Sequence
  Synthetic
atttggagtgaagtgcgcctcgtt

SEQ ID NO: 3691 - DNA, 23 bp, Artificial Sequence
  Synthetic
aacgaggcgcactcactccaaat

SEQ ID NO: 3692 - DNA, 27 bp, Artificial Sequence
  Synthetic
ttgtggattgttgagagagtcgatgta

SEQ ID NO: 3693 - DNA, 20 bp, Artificial Sequence
  Synthetic
gatgtgctagtgatcacatc

SEQ ID NO: 3694 - DNA, 23 bp, Artificial Sequence
  Synthetic
atttggagtgagtgcgcctcgtt

SEQ ID NO: 3695 - DNA, 27 bp, Artificial Sequence
  Synthetic
aacgaggcgcaccataatgaaggagag

SEQ ID NO: 3696 - DNA, 21 bp, Artificial Sequence
  Synthetic
gggtgagtggccagttcataa

SEQ ID NO: 3697 - DNA, 17 bp, Artificial Sequence
  Synthetic
aacactgctcgtggttt

SEQ ID NO: 3698 - DNA, 21 bp, Artificial Sequence
  Synthetic
ctctccttcattatggtgcgc

SEQ ID NO: 3699 - DNA, 26 bp, Artificial Sequence
  Synthetic
aacgaggcgcagataatgaaggagag

SEQ ID NO: 3700 - DNA, 21 bp, Artificial Sequence
  Synthetic
ggtgagtggcctgttcatacc

SEQ ID NO: 3701 - DNA, 17 bp, Artificial Sequence
  Synthetic
aacactgctcgtggttt

SEQ ID NO: 3702 - DNA, 20 bp, Artificial Sequence
  Synthetic
ctctccttcattatctgcgc

SEQ ID NO: 3703 - DNA, 24 bp, Artificial Sequence
  Synthetic
aacgaggcgcacgagagcaaacct

SEQ ID NO: 3704 - DNA, 30 bp, Artificial Sequence
  Synthetic
actctgattagagcaagtttcatgttcatc

SEQ ID NO: 3705 - DNA, 18 bp, Artificial Sequence
  Synthetic
catgccaatgcagtttct

SEQ ID NO: 3706 - DNA, 18 bp, Artificial Sequence
  Synthetic
aggtttgctctcgtgcgc

SEQ ID NO: 3707 - DNA, 23 bp, Artificial Sequence
  Synthetic
aacgaggcgcacgtttcaaggtg

SEQ ID NO: 3708 - DNA, 20 bp, Artificial Sequence
  Synthetic
ctgtaggccccaaagacgtc

SEQ ID NO: 3709 - DNA, 14 bp, Artificial Sequence
  Synthetic
acaggcttgcctgt

SEQ ID NO: 3710 - DNA, 23 bp, Artificial Sequence
  Synthetic
caccttgaaacgtgcgcctcgtt

SEQ ID NO: 3711 - DNA, 22 bp, Artificial Sequence
  Synthetic
aacgaggcgcactttcaaggtg

SEQ ID NO: 3712 - DNA, 21 bp, Artificial Sequence
  Synthetic
ctgtaggccccaaagacgtga

SEQ ID NO: 3713 - DNA, 14 bp, Artificial Sequence
  Synthetic
acaggcttgcctgt

SEQ ID NO: 3714 - DNA, 22 bp, Artificial Sequence
  Synthetic
caccttgaaagtgcgcctcgtt

SEQ ID NO: 3715 - DNA, 24 bp, Artificial Sequence
  Synthetic
aacgaggcgcacctcactccaaat

SEQ ID NO: 3716 - DNA, 28 bp, Artificial Sequence
  Synthetic
tcttgtggattgttgagagagtcgatga

SEQ ID NO: 3717 - DNA, 20 bp, Artificial Sequence
  Synthetic
gatgtgctagtgatcacatc

SEQ ID NO: 3718 - DNA, 24 bp, Artificial Sequence
  Synthetic
atttggagtgaggtgcgcctcgtt

SEQ ID NO: 3719 - DNA, 27 bp, Artificial Sequence
  Synthetic
aacgaggcgcactataatgaaggagag

SEQ ID NO: 3720 - DNA, 21 bp, Artificial Sequence
  Synthetic
gggtgagtggccagttcataa

SEQ ID NO: 3721 - DNA, 17 bp, Artificial Sequence
  Synthetic
aacactgctcgtggttt

SEQ ID NO: 3722 - DNA, 21 bp, Artificial Sequence
  Synthetic
ctctccttcattatagtgcgc

SEQ ID NO: 3723 - DNA, 26 bp, Artificial Sequence
  Synthetic
aacgaggcgcagataatgaaggagag

SEQ ID NO: 3724 - DNA, 22 bp, Artificial Sequence
  Synthetic
gggtgagtggccagttcatatc

SEQ ID NO: 3725 - DNA, 17 bp, Artificial Sequence
  Synthetic
aacactgctcgtggttt

SEQ ID NO: 3726 - DNA, 20 bp, Artificial Sequence
  Synthetic
ctctccttcattatctgcgc

SEQ ID NO: 3727 - DNA, 24 bp, Artificial Sequence
  Synthetic
aacgaggcgcaccgagagcaaacc

SEQ ID NO: 3728 - DNA, 27 bp, Artificial Sequence
  Synthetic
tctgactagagcaagtttcatgttcaa

SEQ ID NO: 3729 - DNA, 18 bp, Artificial Sequence
  Synthetic
tcatgccaatgcagtttc

SEQ ID NO: 3730 - DNA, 18 bp, Artificial Sequence
  Synthetic
ggtttgctctcggtgcgc

SEQ ID NO: 3731 - DNA, 24 bp, Artificial Sequence
  Synthetic
aacgaggcgcaggagagcaaacct

SEQ ID NO: 3732 - DNA, 28 bp, Artificial Sequence
  Synthetic
tctgactagagcaagtttcatgttcacc

SEQ ID NO: 3733 - DNA, 18 bp, Artificial Sequence
  Synthetic
catgccaatgcagtttct

SEQ ID NO: 3734 - DNA, 18 bp, Artificial Sequence
  Synthetic
aggtttcgtctcctgcgc

SEQ ID NO: 3735 - DNA, 25 bp, Artificial Sequence
  Synthetic
aacgaggcgcacagcatgataagca

SEQ ID NO: 3736 - DNA, 19 bp, Artificial Sequence
  Synthetic
tgcttatcatgctgtgcgc

SEQ ID NO: 3737 - DNA, 25 bp, Artificial Sequence
  Synthetic
ccgtcacgcctcagcatgataagca

SEQ ID NO: 3738 - DNA, 19 bp, Artificial Sequence
  Synthetic
tgcttatcatgctgaggcg

SEQ ID NO: 3739 - DNA, 17 bp, Artificial Sequence
  Synthetic
ggtgcagcccagtgagc

SEQ ID NO: 3740 - DNA, 22 bp, Artificial Sequence
  Synthetic
gcaacattaacaccaggatgat

SEQ ID NO: 3741 - DNA, 25 bp, Artificial Sequence
  Synthetic
aacgaggcgcacggaggtgaattag

SEQ ID NO: 3742 - DNA, 19 bp, Artificial Sequence
  Synthetic
ctaattcacctccgtgcgc

SEQ ID NO: 3743 - DNA, 25 bp, Artificial Sequence
  Synthetic
ccgtcacgcctcggaggtgaattag

SEQ ID NO: 3744 - DNA, 19 bp, Artificial Sequence
  Synthetic
ctaattcacctccgaggcg

SEQ ID NO: 3745 - DNA, 24 bp, Artificial Sequence
  Synthetic
tcacagcccatttttcttgttcac

SEQ ID NO: 3746 - DNA, 18 bp, Artificial Sequence
  Synthetic
tgttaagcacctgtttct

SEQ ID NO: 3747 - DNA, 24 bp, Artificial Sequence
  Synthetic
aacgaggcgcacggaggtgaatta

SEQ ID NO: 3748 - DNA, 18 bp, Artificial Sequence
  Synthetic
taattcacctccgtgcgc

SEQ ID NO: 3749 - DNA, 24 bp, Artificial Sequence
  Synthetic
ccgtcacgcctcggaggtgaatta

SEQ ID NO: 3750 - DNA, 18 bp, Artificial Sequence
  Synthetic
taattcacctccgaggcg

SEQ ID NO: 3751 - DNA, 24 bp, Artificial Sequence
  Synthetic
tcacagcccatttttcttgttcac

SEQ ID NO: 3752 - DNA, 18 bp, Artificial Sequence
  Synthetic
gtgttaagcacctgtttc

SEQ ID NO: 3753 - DNA, 25 bp, Artificial Sequence
  Synthetic
aacgaggcgcacgacagattccttt

SEQ ID NO: 3754 - DNA, 19 bp, Artificial Sequence
  Synthetic
aaaggaatctgtcgtgcgc

SEQ ID NO: 3755 - DNA, 25 bp, Artificial Sequence
  Synthetic
ccgtcacgcctcgacagattccttt

SEQ ID NO: 3756 - DNA, 19 bp, Artificial Sequence
  Synthetic
aaaggaatctgtcgaggcg

SEQ ID NO: 3757 - DNA, 25 bp, Artificial Sequence
  Synthetic
atgtcgcagtgactttcccaatagc

SEQ ID NO: 3758 - DNA, 24 bp, Artificial Sequence
  Synthetic
tacctttatatgtgtcgattatgg

SEQ ID NO: 3759 - DNA, 24 bp, Artificial Sequence
  Synthetic
aacgaggcgcacggttttcaactg

SEQ ID NO: 3760 - DNA, 18 bp, Artificial Sequence
  Synthetic
cagttgaaaaccgtgcgc

SEQ ID NO: 3761 - DNA, 24 bp, Artificial Sequence
  Synthetic
ccgtcacgcctcggttttcaactg

SEQ ID NO: 3762 - DNA, 18 bp, Artificial Sequence
  Synthetic
cagttgaaaaccgaggcg

SEQ ID NO: 3763 - DNA, 26 bp, Artificial Sequence
  Synthetic
tctgtgcagaaacaatagttgtctgc

SEQ ID NO: 3764 - DNA, 15 bp, Artificial Sequence
  Synthetic
gagaggcaaaggcct

SEQ ID NO: 3765 - DNA, 30 bp, Artificial Sequence
  Synthetic
aacgaggcgcaccgtatttgaagacataag

SEQ ID NO: 3766 - DNA, 23 bp, Artificial Sequence
  Synthetic
ggctgaccatactgttgctctaa

SEQ ID NO: 3767 - DNA, 22 bp, Artificial Sequence
  Synthetic
taaaagcaccaatatagctgct

SEQ ID NO: 3768 - DNA, 24 bp, Artificial Sequence
  Synthetic
cttatgtcttcaaatacggtgcgc

SEQ ID NO: 3769 - DNA, 26 bp, Artificial Sequence
  Synthetic
aacgaggcgcaccagcagtaaaacat

SEQ ID NO: 3770 - DNA, 23 bp, Artificial Sequence
  Synthetic
aggtaaaaggacaatgacatcaa

SEQ ID NO: 3771 - DNA, 21 bp, Artificial Sequence
  Synthetic
gagaatttggcaattccaacg

SEQ ID NO: 3772 - DNA, 20 bp, Artificial Sequence
  Synthetic
atgttttactgctggtgcgc

SEQ ID NO: 3773 - DNA, 28 bp, Artificial Sequence
  Synthetic
aacgaggcgcacctacatatccaatatc

SEQ ID NO: 3774 - DNA, 30 bp, Artificial Sequence
  Synthetic
cttaggagttattctgatagtgctcagata

SEQ ID NO: 3775 - DNA, 25 bp, Artificial Sequence
  Synthetic
cacgtacattttagcaaacagagat

SEQ ID NO: 3776 - DNA, 22 bp, Artificial Sequence
  Synthetic
gatattggatatgtaggtgcgc

SEQ ID NO: 3777 - DNA, 28 bp, Artificial Sequence
  Synthetic
aacgaggcgcaccaagaaggatatcatc

SEQ ID NO: 3778 - DNA, 30 bp, Artificial Sequence
  Synthetic
cagattagagggaaatatagaagttgaaaa

SEQ ID NO: 3779 - DNA, 29 bp, Artificial Sequence
  Synthetic
gaagtaagaaatgaaaatttggcaattcc

SEQ ID NO: 3780 - DNA, 22 bp, Artificial Sequence
  Synthetic
gatgatatccttcttggtgcgc

SEQ ID NO: 3781 - DNA, 26 bp, Artificial Sequence
  Synthetic
aacgaggcgcactaaatgtggtacct

SEQ ID NO: 3782 - DNA, 31 bp, Artificial Sequence
  Synthetic
caggttgaacaatcttcacagtcaacaagaa

SEQ ID NO: 3783 - DNA, 20 bp, Artificial Sequence
  Synthetic
cctgttgcagagaacaaaga

SEQ ID NO: 3784 - DNA, 20 bp, Artificial Sequence
  Synthetic
aggtaccacatttagtgcgc

SEQ ID NO: 3785 - DNA, 21 bp, Artificial Sequence
  Synthetic
aacgaggcgcacgctgttgtc

SEQ ID NO: 3786 - DNA, 25 bp, Artificial Sequence
  Synthetic
gctgcagttggtgtagaaaacctgc

SEQ ID NO: 3787 - DNA, 15 bp, Artificial Sequence
  Synthetic
cagagcatcctggac

SEQ ID NO: 3788 - DNA, 15 bp, Artificial Sequence
  Synthetic
gacaacagcgtgcgc

SEQ ID NO: 3789 - DNA, 24 bp, Artificial Sequence
  Synthetic
aacgaggcgcacccaaaatcctca

SEQ ID NO: 3790 - DNA, 16 bp, Artificial Sequence
  Synthetic
ggctgggcatccagga

SEQ ID NO: 3791 - DNA, 19 bp, Artificial Sequence
  Synthetic
ggaacatgaactggatgcc

SEQ ID NO: 3792 - DNA, 18 bp, Artificial Sequence
  Synthetic
tgaggattttgggtgcgc

SEQ ID NO: 3793 - DNA, 22 bp, Artificial Sequence
  Synthetic
ccgtcacgcctcgctaaggctc

SEQ ID NO: 3794 - DNA, 26 bp, Artificial Sequence
  Synthetic
gttcattcctacctgacaggagatgc

SEQ ID NO: 3795 - DNA, 18 bp, Artificial Sequence
  Synthetic
aaagaaggtgatccaggc

SEQ ID NO: 3796 - DNA, 16 bp, Artificial Sequence
  Synthetic
gagccttagcgaggcg

SEQ ID NO: 3797 - DNA, 23 bp, Artificial Sequence
  Synthetic
aacgaggcgcacccttgaccttc

SEQ ID NO: 3798 - DNA, 17 bp, Artificial Sequence
  Synthetic
gaaggtcaagggtgcgc

SEQ ID NO: 3799 - DNA, 23 bp, Artificial Sequence
  Synthetic
ccgtcacgcctcccttgaccttc

SEQ ID NO: 3800 - DNA, 17 bp, Artificial Sequence
  Synthetic
gaaggtcaagggaggcg

SEQ ID NO: 3801 - DNA, 25 bp, Artificial Sequence
  Synthetic
ttgcgttgcgggcaacatagaccaa

SEQ ID NO: 3802 - DNA, 25 bp, Artificial Sequence
  Synthetic
ttgcgtttcgggcaacatagaccaa

SEQ ID NO: 3803 - DNA, 18 bp, Artificial Sequence
  Synthetic
tgatccaacagagtctgg

SEQ ID NO: 3804 - DNA, 23 bp, Artificial Sequence
  Synthetic
aacgaggcgcacccgcatcgaag

SEQ ID NO: 3805 - DNA, 17 bp, Artificial Sequence
  Synthetic
cttcgatgcgggtgcgc

SEQ ID NO: 3806 - DNA, 23 bp, Artificial Sequence
  Synthetic
ccgtcacgcctcccgcatcgaag

SEQ ID NO: 3807 - DNA, 17 bp, Artificial Sequence
  Synthetic
cttcgatgcgggaggcg

SEQ ID NO: 3808 - DNA, 22 bp, Artificial Sequence
  Synthetic
ctgccatcttctccgcatagta

SEQ ID NO: 3809 - DNA, 14 bp, Artificial Sequence
  Synthetic
cgctcattctgcgc

SEQ ID NO: 3810 - DNA, 22 bp, Artificial Sequence
  Synthetic
aacgaggcgcacccgcatagtc

SEQ ID NO: 3811 - DNA, 16 bp, Artificial Sequence
  Synthetic
gactatgcgggtgcgc

SEQ ID NO: 3812 - DNA, 22 bp, Artificial Sequence
  Synthetic
ccgtcacgcctcccgcatagtc

SEQ ID NO: 3813 - DNA, 16 bp, Artificial Sequence
  Synthetic
gactatgcgggaggcg

SEQ ID NO: 3814 - DNA, 19 bp, Artificial Sequence
  Synthetic
tgcagcctgccatcttcta

SEQ ID NO: 3815 - DNA, 16 bp, Artificial Sequence
  Synthetic
cgcatcgaagcgctca

SEQ ID NO: 3816 - DNA, 25 bp, Artificial Sequence
  Synthetic
aacgaggcgcaccaattgccatagc

SEQ ID NO: 3817 - DNA, 19 bp, Artificial Sequence
  Synthetic
gctatggcaattggtgcgc

SEQ ID NO: 3818 - DNA, 25 bp, Artificial Sequence
  Synthetic
ccgtcacgcctccaattgccatagc

SEQ ID NO: 3819 - DNA, 19 bp, Artificial Sequence
  Synthetic
gctatggcaattggaggcg

SEQ ID NO: 3820 - DNA, 25 bp, Artificial Sequence
  Synthetic
gagggattttgcccaaagcatcaga

SEQ ID NO: 3821 - DNA, 20 bp, Artificial Sequence
  Synthetic
tttcttctctggaatttctg

SEQ ID NO: 3822 - DNA, 23 bp, Artificial Sequence
  Synthetic
aacgaggcgcaccgctttgcatt

SEQ ID NO: 3823 - DNA, 17 bp, Artificial Sequence
  Synthetic
aatgcaaagcggtgcgc

SEQ ID NO: 3824 - DNA, 23 bp, Artificial Sequence
  Synthetic
ccgtcacgcctccgctttgcatt

SEQ ID NO: 3825 - DNA, 17 bp, Artificial Sequence
  Synthetic
aatgcaaagcggaggcg

SEQ ID NO: 3826 - DNA, 21 bp, Artificial Sequence
  Synthetic
cagctcccttagtctccatga

SEQ ID NO: 3827 - DNA, 19 bp, Artificial Sequence
  Synthetic
gtccatctgatcaccaaac

SEQ ID NO: 3828 - DNA, 22 bp, Artificial Sequence
  Synthetic
aacgaggcgcaccgacggccaa

SEQ ID NO: 3829 - DNA, 16 bp, Artificial Sequence
  Synthetic
ttggccgtcggtgcgc

SEQ ID NO: 3830 - DNA, 22 bp, Artificial Sequence
  Synthetic
ccgtcacgcctccgacggccaa

SEQ ID NO: 3831 - DNA, 16 bp, Artificial Sequence
  Synthetic
ttggccgtcggaggcg

SEQ ID NO: 3832 - DNA, 23 bp, Artificial Sequence
  Synthetic
gtgatgaaggccactgtcagcaa

SEQ ID NO: 3833 - DNA, 19 bp, Artificial Sequence
  Synthetic
gaggaaaccaatcacgtcc

SEQ ID NO: 3834 - DNA, 13 bp, Artificial Sequence
  Synthetic
  misc_feature (3)..(3): The residue at this position is linked to a Z28 quenching group.
cactgcttcgtgg

SEQ ID NO: 3835 - DNA, 27 bp, Artificial Sequence
  Synthetic
ccaggaagcaagtggtgcgcctcgttt

SEQ ID NO: 3836 - DNA, 27 bp, Artificial Sequence
  Synthetic
ccaggaagcaagtggaggcgtgacggt

SEQ ID NO: 3837 - DNA, 27 bp, Artificial Sequence
  Synthetic
ccaggaagcaagtgacgcagcgacggt

SEQ ID NO: 3838 - DNA, 23 bp, Artificial Sequence
  Synthetic
aacgaggcgcactgtgagcagga

SEQ ID NO: 3839 - DNA, 26 bp, Artificial Sequence
  Synthetic
ggttccagaaggttagaagtgaggca

SEQ ID NO: 3840 - DNA, 12 bp, Artificial Sequence
  Synthetic
gcctctgccagg

SEQ ID NO: 3841 - DNA, 17 bp, Artificial Sequence
  Synthetic
tcctgctcacagtgcgc

SEQ ID NO: 3842 - DNA, 24 bp, Artificial Sequence
  Synthetic
aacgaggcgcacaatcactgcgcc

SEQ ID NO: 3843 - DNA, 26 bp, Artificial Sequence
  Synthetic
ccatagaggacattcaggatgactgc

SEQ ID NO: 3844 - DNA, 14 bp, Artificial Sequence
  Synthetic
tggcactcactggg

SEQ ID NO: 3845 - DNA, 17 bp, Artificial Sequence
  Synthetic
tcctgctcacagtgcgc

SEQ ID NO: 3846 - DNA, 23 bp, Artificial Sequence
  Synthetic
aacgaggcgcacaatcactgcgc

SEQ ID NO: 3847 - DNA, 14 bp, Artificial Sequence
  Synthetic
ctggcactcactgg

SEQ ID NO: 3848 - DNA, 17 bp, Artificial Sequence
  Synthetic
gcgcagtgattgtgcgc

SEQ ID NO: 3849 - DNA, 22 bp, Artificial Sequence
  Synthetic
ccgtcacgcctccttgctgtgt

SEQ ID NO: 3850 - DNA, 24 bp, Artificial Sequence
  Synthetic
ggttctgggtttcacatttgtaga

SEQ ID NO: 3851 - DNA, 25 bp, Artificial Sequence
  Synthetic
catttcttgtgacattgaatagagt

SEQ ID NO: 3852 - DNA, 17 bp, Artificial Sequence
  Synthetic
acacagcaaggaggcgc

SEQ ID NO: 3853 - DNA, 23 bp, Artificial Sequence
  Synthetic
aacgaggcgcaccactgagtaga

SEQ ID NO: 3854 - DNA, 23 bp, Artificial Sequence
  Synthetic
ggtcctacatcattccttgtgaa

SEQ ID NO: 3855 - DNA, 14 bp, Artificial Sequence
  Synthetic
gtgagggtcctgtt

SEQ ID NO: 3856 - DNA, 17 bp, Artificial Sequence
  Synthetic
tctactcagtggtgcgc

SEQ ID NO: 3857 - DNA, 21 bp, Artificial Sequence
  Synthetic
aacgaggcgcacttgctggat

SEQ ID NO: 3858 - DNA, 27 bp, Artificial Sequence
  Synthetic
ttggagataaagagctcttgtgtgtga

SEQ ID NO: 3859 - DNA, 16 bp, Artificial Sequence
  Synthetic
gttcccatcaatcaga

SEQ ID NO: 3860 - DNA, 15 bp, Artificial Sequence
  Synthetic
atccagcaagtgcgc

SEQ ID NO: 3861 - DNA, 29 bp, Artificial Sequence
  Synthetic
ccgtcacgcctcgtttctatctcctttgt

SEQ ID NO: 3862 - DNA, 23 bp, Artificial Sequence
  Synthetic
cgtcagttggtcggttcctgttc

SEQ ID NO: 3863 - DNA, 23 bp, Artificial Sequence
  Synthetic
acaaaggagatagaaacgaggcg

SEQ ID NO: 3864 - DNA, 23 bp, Artificial Sequence
  Synthetic
ccgtcacgcctcgtttctatctc

SEQ ID NO: 3865 - DNA, 23 bp, Artificial Sequence
  Synthetic
cgtcagttggtcggttcctgttc

SEQ ID NO: 3866 - DNA, 16 bp, Artificial Sequence
  Synthetic
ctttgttaccgcttcc

SEQ ID NO: 3867 - DNA, 17 bp, Artificial Sequence
  Synthetic
gagatagaaacgaggcg

SEQ ID NO: 3868 - DNA, 22 bp, Artificial Sequence
  Synthetic
aacgcggcgcactgttgttcct

SEQ ID NO: 3869 - DNA, 19 bp, Artificial Sequence
  Synthetic
gctgggccatgcagtagaa

SEQ ID NO: 3870 - DNA, 14 bp, Artificial Sequence
  Synthetic
gagcccgaggatgt

SEQ ID NO: 3871 - DNA, 16 bp, Artificial Sequence
  Synthetic
aggaacaacagtgcgc

SEQ ID NO: 3872 - DNA, 21 bp, Artificial Sequence
  Synthetic
aacgaggcgcactgttgttcc

SEQ ID NO: 3873 - DNA, 15 bp, Artificial Sequence
  Synthetic
tgagcccgaggatgt

SEQ ID NO: 3874 - DNA, 23 bp, Artificial Sequence
  Synthetic
aacgaggcgcacgtctgagttgt

SEQ ID NO: 3875 - DNA, 15 bp, Artificial Sequence
  Synthetic
gtgggctcagccgtc

SEQ ID NO: 3876 - DNA, 12 bp, Artificial Sequence
  Synthetic
ccagcagctggg

SEQ ID NO: 3877 - DNA, 17 bp, Artificial Sequence
  Synthetic
acaactcagacgtgcgc

SEQ ID NO: 3878 - DNA, 25 bp, Artificial Sequence
  Synthetic
ccgtcacgcctcggcttgtgtgttc

SEQ ID NO: 3879 - DNA, 24 bp, Artificial Sequence
  Synthetic
ccgggataggttcagggaggcgtc

SEQ ID NO: 3880 - DNA, 18 bp, Artificial Sequence
  Synthetic
ggtttcatgggggtccct

SEQ ID NO: 3881 - DNA, 19 bp, Artificial Sequence
  Synthetic
gaacacacaagccgaggcg

SEQ ID NO: 3882 - DNA, 21 bp, Artificial Sequence
  Synthetic
aacgaggcgcacggcttgtgt

SEQ ID NO: 3883 - DNA, 20 bp, Artificial Sequence
  Synthetic
gataggttcagggaggcgtc

SEQ ID NO: 3884 - DNA, 16 bp, Artificial Sequence
  Synthetic
gttcggtttcatgggg

SEQ ID NO: 3885 - DNA, 15 bp, Artificial Sequence
  Synthetic
acacaagccgtgcgc

SEQ ID NO: 3886 - DNA, 28 bp, Artificial Sequence
  Synthetic
aacgaggcgcacgtatttcttgatcttc

SEQ ID NO: 3887 - DNA, 21 bp, Artificial Sequence
  Synthetic
ttttgggcctgttgtagtctc

SEQ ID NO: 3888 - DNA, 17 bp, Artificial Sequence
  Synthetic
cgctggcggttatagag

SEQ ID NO: 3889 - DNA, 22 bp, Artificial Sequence
  Synthetic
gaagatcaagaaatacgtgcgc

SEQ ID NO: 3890 - DNA, 20 bp, Artificial Sequence
  Synthetic
aacgaggcgcacaccatggc

SEQ ID NO: 3891 - DNA, 23 bp, Artificial Sequence
  Synthetic
ctagtgttttaggtgtgcaggtc

SEQ ID NO: 3892 - DNA, 19 bp, Artificial Sequence
  Synthetic
cccaaatgctgttgtatct

SEQ ID NO: 3893 - DNA, 14 bp, Artificial Sequence
  Synthetic
gccatggtgtgcgc

SEQ ID NO: 3894 - DNA, 21 bp, Artificial Sequence
  Synthetic
aacgaggcgcacaccatggcc

SEQ ID NO: 3895 - DNA, 23 bp, Artificial Sequence
  Synthetic
ctagtgttttaggtgtgcaggtc

SEQ ID NO: 3896 - DNA, 20 bp, Artificial Sequence
  Synthetic
ccaaatgctgttgtatctga

SEQ ID NO: 3897 - DNA, 15 bp, Artificial Sequence
  Synthetic
ggccatggtgtgcgc

SEQ ID NO: 3898 - DNA, 24 bp, Artificial Sequence
  Synthetic
aacgcggcgcacgccattttccac

SEQ ID NO: 3899 - DNA, 27 bp, Artificial Sequence
  Synthetic
ccacagtcgatgaatccagaaaagcga

SEQ ID NO: 3900 - DNA, 19 bp, Artificial Sequence
  Synthetic
catgatattcggcaagcag

SEQ ID NO: 3901 - DNA, 17 bp, Artificial Sequence
  Synthetic
tggaaaatggcgtgcgc

SEQ ID NO: 3902 - DNA, 23 bp, Artificial Sequence
  Synthetic
aacgcggcgcacgccattttcca

SEQ ID NO: 3903 - DNA, 20 bp, Artificial Sequence
  Synthetic
ccatgatattcggcaagcag

SEQ ID NO: 3904 - DNA, 24 bp, Artificial Sequence
  Synthetic
aacgaggcgcaccagttcattcag

SEQ ID NO: 3905 - DNA, 16 bp, Artificial Sequence
  Synthetic
cgctgcctcgtcctga

SEQ ID NO: 3906 - DNA, 13 bp, Artificial Sequence
  Synthetic
ggcaccggacagg

SEQ ID NO: 3907 - DNA, 18 bp, Artificial Sequence
  Synthetic
ctgaatgaactggtgcgc

SEQ ID NO: 3908 - DNA, 24 bp, Artificial Sequence
  Synthetic
ccgtcacgcctcgtccattgttca

SEQ ID NO: 3909 - DNA, 21 bp, Artificial Sequence
  Synthetic
tggtccctgttgtatcctttc

SEQ ID NO: 3910 - DNA, 18 bp, Artificial Sequence
  Synthetic
tcatcatcaaagtgggca

SEQ ID NO: 3911 - DNA, 18 bp, Artificial Sequence
  Synthetic
tgaacaatggacgaggcg

SEQ ID NO: 3912 - DNA, 25 bp, Artificial Sequence
  Synthetic
ccgtcacgcctcgtccattgttcat

SEQ ID NO: 3913 - DNA, 19 bp, Artificial Sequence
  Synthetic
catcatcaaagtgggcatc

SEQ ID NO: 3914 - DNA, 19 bp, Artificial Sequence
  Synthetic
atgaacaatggacgaggcg

SEQ ID NO: 3915 - DNA, 26 bp, Artificial Sequence
  Synthetic
aacgaggcgcactcaagggataagga

SEQ ID NO: 3916 - DNA, 22 bp, Artificial Sequence
  Synthetic
cctcggagactggtaatggcaa

SEQ ID NO: 3917 - DNA, 17 bp, Artificial Sequence
  Synthetic
agggtcacatttgtctg

SEQ ID NO: 3918 - DNA, 20 bp, Artificial Sequence
  Synthetic
tccttatcccttgagtgcgc

SEQ ID NO: 3919 - DNA, 20 bp, Artificial Sequence
  Synthetic
ccgtcgctgcgtttcttccc

SEQ ID NO: 3920 - DNA, 22 bp, Artificial Sequence
  Synthetic
caagctttctcctgatagctca

SEQ ID NO: 3921 - DNA, 14 bp, Artificial Sequence
  Synthetic
ctaccccgcacttc

SEQ ID NO: 3922 - DNA, 14 bp, Artificial Sequence
  Synthetic
gggaagaaacgcag

SEQ ID NO: 3923 - DNA, 21 bp, Artificial Sequence
  Synthetic
ccgtcgctgcgtttcttcccc

SEQ ID NO: 3924 - DNA, 14 bp, Artificial Sequence
  Synthetic
taccccgcacttct

SEQ ID NO: 3925 - DNA, 15 bp, Artificial Sequence
  Synthetic
ggggaagaaacgcag

SEQ ID NO: 3926 - DNA, 22 bp, Artificial Sequence
  Synthetic
aacgaggcgcacggcatcaagg

SEQ ID NO: 3927 - DNA, 24 bp, Artificial Sequence
  Synthetic
gtttctcctcggagactggtaatc

SEQ ID NO: 3928 - DNA, 21 bp, Artificial Sequence
  Synthetic
gataaggaagggtcacatttg

SEQ ID NO: 3929 - DNA, 16 bp, Artificial Sequence
  Synthetic
ccttgatgccgtgcgc

SEQ ID NO: 3930 - DNA, 21 bp, Artificial Sequence
  Synthetic
aacgaggcgcactcttcttcc

SEQ ID NO: 3931 - DNA, 24 bp, Artificial Sequence
  Synthetic
gaaccaagctttctcctgatagca

SEQ ID NO: 3932 - DNA, 13 bp, Artificial Sequence
  Synthetic
cctaccccgcact

SEQ ID NO: 3933 - DNA, 15 bp, Artificial Sequence
  Synthetic
ggaagaagagtgcgc

SEQ ID NO: 3934 - DNA, 24 bp, Artificial Sequence
  Synthetic
aacgaggcgcaccttttgttccga

SEQ ID NO: 3935 - DNA, 29 bp, Artificial Sequence
  Synthetic
agagtgatgggaattttctgcattttcta

SEQ ID NO: 3936 - DNA, 24 bp, Artificial Sequence
  Synthetic
gtagtgacatggtaaaagttgttt

SEQ ID NO: 3937 - DNA, 18 bp, Artificial Sequence
  Synthetic
tcggaacaaaaggtgcgc

SEQ ID NO: 3938 - DNA, 23 bp, Artificial Sequence
  Synthetic
aacgaggcgcaccttttgttccg

SEQ ID NO: 3939 - DNA, 29 bp, Artificial Sequence
  Synthetic
agagtgatgggaattttctgcattttcta

SEQ ID NO: 3940 - DNA, 23 bp, Artificial Sequence
  Synthetic
agtagtgacatggtaaaagttgt

SEQ ID NO: 3941 - DNA, 17 bp, Artificial Sequence
  Synthetic
cggaacaaaaggtgcgc

SEQ ID NO: 3942 - DNA, 24 bp, Artificial Sequence
  Synthetic
ccgtcacgcctccttttgttccga

SEQ ID NO: 3943 - DNA, 24 bp, Artificial Sequence
  Synthetic
gtagtgacatggtaaaagttgttt

SEQ ID NO: 3944 - DNA, 18 bp, Artificial Sequence
  Synthetic
tcggaacaaaaggaggcg

SEQ ID NO: 3945 - DNA, 23 bp, Artificial Sequence
  Synthetic
ccgtcacgcctccttttgttccg

SEQ ID NO: 3946 - DNA, 17 bp, Artificial Sequence
  Synthetic
cggaacaaaaggaggcg

SEQ ID NO: 3947 - DNA, 21 bp, Artificial Sequence
  Synthetic
ccgtcacgcctcggagtcaat

SEQ ID NO: 3948 - DNA, 20 bp, Artificial Sequence
  Synthetic
gcaggttgctgtgttgcaac

SEQ ID NO: 3949 - DNA, 18 bp, Artificial Sequence
  Synthetic
gaagaggtgcacagaacg

SEQ ID NO: 3950 - DNA, 15 bp, Artificial Sequence
  Synthetic
attgactccgaggcg

SEQ ID NO: 3951 - DNA, 26 bp, Artificial Sequence
  Synthetic
aacgaggcgcactgatgggaattttc

SEQ ID NO: 3952 - DNA, 20 bp, Artificial Sequence
  Synthetic
gtaattccttcgcccaggga

SEQ ID NO: 3953 - DNA, 20 bp, Artificial Sequence
  Synthetic
tttatttcttcttttgtccc

SEQ ID NO: 3954 - DNA, 20 bp, Artificial Sequence
  Synthetic
gaaaattcccatcagtgcgc

SEQ ID NO: 3955 - DNA, 22 bp, Artificial Sequence
  Synthetic
aacgaggcgcactgcttcttca

SEQ ID NO: 3956 - DNA, 23 bp, Artificial Sequence
  Synthetic
tctcttgactcatctgctcttta

SEQ ID NO: 3957 - DNA, 18 bp, Artificial Sequence
  Synthetic
gtcttttgacttcaggtc

SEQ ID NO: 3958 - DNA, 16 bp, Artificial Sequence
  Synthetic
tgaagaagcagtgcgc

SEQ ID NO: 3959 - DNA, 24 bp, Artificial Sequence
  Synthetic
aacgaggcgcactgcttcttcagt

SEQ ID NO: 3960 - DNA, 23 bp, Artificial Sequence
  Synthetic
tctcttgactcatctgctcttta

SEQ ID NO: 3961 - DNA, 18 bp, Artificial Sequence
  Synthetic
cttttgacttcaggtcac

SEQ ID NO: 3962 - DNA, 18 bp, Artificial Sequence
  Synthetic
actgaagaagcagtgcgc

SEQ ID NO: 3963 - DNA, 23 bp, Artificial Sequence
  Synthetic
ccgtcacgcctcgcctttgtttg

SEQ ID NO: 3964 - DNA, 34 bp, Artificial Sequence; identical to SEQ ID NO: 1702
  Synthetic

SEQ ID NO: 3965 - DNA, 20 bp, Artificial Sequence
  Synthetic
ggttcgaattccatgtcatc

SEQ ID NO: 3966 - DNA, 17 bp, Artificial Sequence
  Synthetic
caaacaaaggcgaggcg

SEQ ID NO: 3967 - DNA, 27 bp, Artificial Sequence
  Synthetic
aacgaggcgcacatgtgtaatttagct

SEQ ID NO: 3968 - DNA, 25 bp, Artificial Sequence
  Synthetic
gtgggcacagaatccatttcatcac

SEQ ID NO: 3969 - DNA, 21 bp, Artificial Sequence
  Synthetic
cggcaaacaagaacttttcca

SEQ ID NO: 3970 - DNA, 21 bp, Artificial Sequence
  Synthetic
agctaaattacacatgtgcgc

SEQ ID NO: 3971 - DNA, 28 bp, Artificial Sequence
  Synthetic
aacgaggcgcacatgtgtaatttagctc

SEQ ID NO: 3972 - DNA, 24 bp, Artificial Sequence
  Synthetic
ggcaaacaagaacttttccaatat

SEQ ID NO: 3973 - DNA, 22 bp, Artificial Sequence
  Synthetic
gagctaaattacacatgtgcgc

SEQ ID NO: 3974 - DNA, 23 bp, Artificial Sequence
  Synthetic
aacgaggcgcacgcctttgtttg

SEQ ID NO: 3975 - DNA, 32 bp, Artificial Sequence
  Synthetic
gcaacattgacataaagtgtttgcgtactctc

SEQ ID NO: 3976 - DNA, 19 bp, Artificial Sequence
  Synthetic
ggttcgaattccatgtcat

SEQ ID NO: 3977 - DNA, 17 bp, Artificial Sequence
  Synthetic
caaacaaaggcgtgcgc

SEQ ID NO: 3978 - DNA, 23 bp, Artificial Sequence
  Synthetic
ccgtcacgcctcgcctttgtttg

SEQ ID NO: 3979 - DNA, 32 bp, Artificial Sequence; identical to SEQ ID NO: 3975
  Synthetic

SEQ ID NO: 3980 - DNA, 19 bp, Artificial Sequence
  Synthetic
ggttcgaattccatgtcat

SEQ ID NO: 3981 - DNA, 17 bp, Artificial Sequence
  Synthetic
caaacaaaggcgaggcg

SEQ ID NO: 3982 - DNA, 21 bp, Artificial Sequence
  Synthetic
aagcaggcgcaccttccttgg

SEQ ID NO: 3983 - DNA, 21 bp, Artificial Sequence
  Synthetic
ctcttcacggcgcttgcgtga

SEQ ID NO: 3984 - DNA, 17 bp, Artificial Sequence
  Synthetic
tcttagacctgcgagcc

SEQ ID NO: 3985 - DNA, 15 bp, Artificial Sequence
  Synthetic
ccaaggaaggtgcgc

SEQ ID NO: 3986 - DNA, 22 bp, Artificial Sequence
  Synthetic
aacgaggcgcactgcttccttg

SEQ ID NO: 3987 - DNA, 20 bp, Artificial Sequence
  Synthetic
gctcttcacggcgcttgcga

SEQ ID NO: 3988 - DNA, 18 bp, Artificial Sequence
  Synthetic
gtcttagacctgcgagcc

SEQ ID NO: 3989 - DNA, 16 bp, Artificial Sequence
  Synthetic
caaggaagcagtgcgc

SEQ ID NO: 3990 - DNA, 21 bp, Artificial Sequence
  Synthetic
aagcaggcgcaccttccttgg

SEQ ID NO: 3991 - DNA, 18 bp, Artificial Sequence
  Synthetic
ctcccggcgctttcgtga

SEQ ID NO: 3992 - DNA, 17 bp, Artificial Sequence
  Synthetic
tcttagacctgcgagcc

SEQ ID NO: 3993 - DNA, 15 bp, Artificial Sequence
  Synthetic
ccaaggaaggtgcgc

SEQ ID NO: 3994 - DNA, 22 bp, Artificial Sequence
  Synthetic
aacgaggcgcactgcttccttg

SEQ ID NO: 3995 - DNA, 17 bp, Artificial Sequence
  Synthetic
cctcccggcgctttcga

SEQ ID NO: 3996 - DNA, 18 bp, Artificial Sequence
  Synthetic
gtcttagacctgcgagcc

SEQ ID NO: 3997 - DNA, 16 bp, Artificial Sequence
  Synthetic
caaggaagcagtgcgc

SEQ ID NO: 3998 - DNA, 14 bp, Artificial Sequence
  Synthetic
  misc_feature (4)..(4): The residue at this position is an Eclipse quencher.
cganttttacttcc

SEQ ID NO: 3999 - DNA, 17 bp, Artificial Sequence
  Synthetic
  misc_feature (4)..(4): The residue at this position is an Eclipse quencher.
cganttttacttcctct

SEQ ID NO: 4000 - DNA, 17 bp, Artificial Sequence
  Synthetic
cgacttttacttcctct

SEQ ID NO: 4001 - DNA, 25 bp, Artificial Sequence
  Synthetic
ggttcacctacggaaaccttgttaa

SEQ ID NO: 4002 - DNA, 22 bp, Artificial Sequence
  Synthetic
tctagatagtcaagttcgaccg

SEQ ID NO: 4003 - DNA, 29 bp, Artificial Sequence
  Synthetic
tctagatagtcaagttcgaccgtcttctc

SEQ ID NO: 4004 - DNA, 17 bp, Artificial Sequence
  Synthetic
agaggaagtaaaattcg

We claim:

1. A kit comprising a recombinant enzyme comprising a 5' nuclease, wherein said recombinant enzyme comprises a polypeptide encoded by the nucleic acid shown in SEQ ID NO: 2856.

2. The kit of claim 1, wherein said polypeptide is shown in SEQ ID NO:2857.

3. The kit of claim 1, further comprising a probe oligonucleotide.

4. The kit of claim 2, further comprising an INVADER oligonucleotide.

5. The kit of claim 1, further comprising a labeled oligonucleotide.

* * * * *